(12) United States Patent
Rubin

(10) Patent No.: US 7,691,599 B2
(45) Date of Patent: Apr. 6, 2010

(54) MAMMALIAN GENES INVOLVED IN VIRAL INFECTION AND TUMOR SUPPRESSION

(75) Inventor: Donald H. Rubin, Nashville, TN (US)

(73) Assignee: Zirus, Inc., Buford, GA (US)

( * ) Notice: Subject to any disclaimer, the term of this patent is extended or adjusted under 35 U.S.C. 154(b) by 702 days.

(21) Appl. No.: 10/513,426

(22) PCT Filed: May 2, 2003

(86) PCT No.: PCT/US03/13743

§ 371 (c)(1),
(2), (4) Date: Oct. 11, 2006

(87) PCT Pub. No.: WO2004/010925

PCT Pub. Date: Feb. 5, 2004

(65) Prior Publication Data

US 2007/0254329 A1  Nov. 1, 2007

Related U.S. Application Data

(60) Provisional application No. 60/377,136, filed on May 2, 2002.

(51) Int. Cl.
*C12Q 1/02*  (2006.01)

(52) U.S. Cl. .......................................................... 435/29
(58) Field of Classification Search .................. None
See application file for complete search history.

(56) References Cited

FOREIGN PATENT DOCUMENTS

WO    WO 99/19481    4/1999

OTHER PUBLICATIONS

Database Accession No. BH 281477 EMBL (on line) "CH230-24L12.TJ Chori-230 Segment 1 *Rattus norvegicus* genomic clone CH23024L12, DNA sequence" (Dec. 5, 2001).
Rubin, Donald H. et al. "Cullular genetics of host susceptibility and resistance to virus infection." *Critical Reviews in Eukaryotic Gene Expression* 16(2):155-170 (2006).
Sakai Tohru et a. "Expression and role of heat-shock protein 65 (HSP65) in macrophages during *Trypanosoma cruzi* infection: Involvement of HSP65 in prevention of apoptosis of macrphages." *Microbes and Infection* 1(6):419-427 (May 1999).

*Primary Examiner*—James Martinell
(74) *Attorney, Agent, or Firm*—Ballard Spahr LLP

(57) ABSTRACT

The present invention provides methods of identifying cellular genes used for viral, bacterial or parasitic growth. Also provided by the present invention are nucleic acids related to and methods of reducing or preventing viral, bacterial or parasitic infection.

1 Claim, No Drawings

MAMMALIAN GENES INVOLVED IN VIRAL INFECTION AND TUMOR SUPPRESSION

This application claims priority to U.S. Provisional Application Ser. No. 60/377,136, filed May 2, 2002 which is hereby incorporated in its entirety by this reference.

ACKNOWLEDGEMENTS

This invention was made with government support under grant CA68283 awarded by the NIH. The government has certain rights in the invention.

BACKGROUND

1. Field of the Invention

The present invention provides methods of identifying cellular genes used for viral, bacterial or parasitic growth or for tumor progression. Thus, the present invention relates to nucleic acids related to and methods of reducing or preventing viral, bacterial or parasitic infection and for suppressing tumor progression. The invention also relates to methods for screening for additional such genes.

2. Background Art

Various projects have been directed toward isolating and sequencing the genome of various animals, notably the human. However, most methodologies provide nucleotide sequences for which no function is linked or even suggested, thus limiting the immediate usefulness of such data.

The present invention, in contrast, provides methods of screening only for nucleic acids that are involved in a specific process, i.e., viral infection, bacterial or parasitic or tumor progression, and further, for nucleic acids useful in treatments for these processes because by this method only nucleic acids which are also nonessential to the cell are isolated. Such methods are highly useful, since they ascribe a function to each isolated gene, and thus the isolated nucleic acids can immediately be utilized in various specific methods and procedures.

For, example, the present invention provides methods of isolating nucleic acids encoding gene products used for viral infection, but nonessential to the cell. Viral infections of the intestine and liver are significant causes of human morbidity and mortality. Understanding the molecular mechanisms of such infections will lead to new approaches in their treatment and control.

Viruses can establish a variety of types of infection. These infections can be generally classified as lytic or persistent, though some lytic infections are considered persistent. Generally, persistent infections fall into two categories: (1) chronic (productive) infection, i.e., infection wherein infectious virus is present and can be recovered by traditional biological methods and (2) latent infection, i.e., infection wherein viral genome is present in the cell but infectious virus is generally not produced except during intermittent episodes of reactivation. Persistence generally involves stages of both productive and latent infection.

Lytic infections can also persist under conditions where only a small fraction of the total cells are infected (smoldering (cycling) infection). The few infected cells release virus and are killed, but the progeny virus again only infect a small number of the total cells. Examples of such smoldering infections include the persistence of lactic dehydrogenase virus in mice (Mahy, B. W. J., *Br. Med. Bull.* 41: 50-55 (1985)) and adenovirus infection in humans (Porter, D. D. pp. 784-790 in Baron, S., ed. *Medical Microbiology* 2d ed. (Addison-Wesley, Menlo Park, Calif. 1985)).

Furthermore, a virus may be lytic for some cell types but not for others. For example, evidence suggests that human immunodeficiency virus (HIV) is more lytic for T cells than for monocytes/macrophages, and therefore can result in a productive infection of T cells that can result in cell death, whereas HIV-infected mononuclear phagocytes may produce virus for considerable periods of time without cell lysis. (Klatzmann, et al. *Science* 225:59-62 (1984); Koyanagi, et al. *Science* 241:1673-1675 (1988); Sattentau, et al. *Cell* 52:631-633 (1988)).

Traditional treatments for viral infection include pharmaceuticals aimed at specific virus derived proteins, such as HIV protease or reverse transcriptase, or recombinant (cloned) immune modulators (host derived), such as the interferons. However, the current methods have several limitations and drawbacks which include high rates of viral mutations which render anti-viral pharmaceuticals ineffective. For immune modulators, limited effectiveness, limiting side effects, a lack of specificity all limit the general applicability of these agents. Also the rate of success with current antivirals and immune-modulators has been disappointing.

The current invention focuses on isolating genes that are not essential for cellular survival when disrupted in one or both alleles, but which are required for virus replication. This may occur with a dose effect, in which one allele knock-out may confer the phenotype of virus resistance for the cell. As targets for therapeutic intervention, inhibition of these cellular gene products, including: proteins, parts of proteins (modification enzymes that include, but are not restricted to glycosylation, lipid modifiers [myriolate, etc.]), lipids, transcription elements and RNA regulatory molecules, may be less likely to have profound toxic side effects and virus mutation is less likely to overcome the 'block' to replicate successfully.

The present invention provides a significant improvement over previous methods of attempted therapeutic intervention against viral infection by addressing the cellular genes required by the virus for growth. Therefore, the present invention also provides an innovative therapeutic approach to intervention in viral infection by providing methods to treat viruses by inhibiting the cellular genes necessary for viral infection. Because these genes, by virtue of the means by which they are originally detected, are nonessential to the cell's survival, these treatment methods can be used in a subject without serious detrimental effects to the subject, as has been found with previous methods. The present invention also provides the surprising discovery that virally infected cells are dependent upon a factor in serum to survive. Therefore, the present invention also provides a method for treating viral infection by inhibiting this serum survival factor. Finally, these discoveries also provide a novel method for removing virally infected cells from a cell culture by removing, inhibiting or disrupting this serum survival factor in the culture so that non-infected cells selectively survive.

The methods provided herein can also be used against bacterial and/or parasitic infections. Specifically, the same methods are employed but a parasite or bacteria replaces the virus.

The selection of tumor suppressor gene(s) has become an important area in the discovery of new target for therapeutic intervention of cancer. Since the discovery that cells are restricted from promiscuous entry into the cell cycle by specific genes that are capable of suppressing a 'transformed' phenotype, considerable time has been invested in the discovery of such genes. Some of these genes include the gene associated by rhabdomyosarcoma (Rb) and the p53 (apoptosis related) encoding gene. The present invention provides a method, using gene-trapping, to select cell lines that have transformed phenotype from cells that are not transformed and to isolate from these cells a gene that either participates in or can suppress a malignant phenotype. Thus, by the nature of the isolation process, a function is associated with the isolated genes. The capacity to select quickly tumor suppressor genes or oncogenes can provide unique targets in the process of treating or preventing, and even for diagnostic testing of, cancer.

DETAILED DESCRIPTION OF THE INVENTION

The present invention utilizes a "gene trap" method along with a selection process to identify and isolate nucleic acids from genes associated with a particular function. Specifically, it provides a means of isolating cellular genes necessary for viral infection but not essential for the cell's survival, and it provides a means of isolating cellular genes that suppress tumor progression.

The present invention also provides a core discovery that virally infected cells become dependent upon at least one factor present in serum for survival, whereas non-infected cells do not exhibit this dependence. This core discovery has been utilized in the present invention in several ways. First, inhibition of the "serum survival factor" can be utilized to eradicate persistently virally infected cells from populations of non-infected cells. Inhibition of this factor can also be used to treat virus infection in a subject, as further described herein. Additionally, inhibition of or withdrawal of the serum survival factor in tissue culture allows for the detection of cellular genes required for viral replication yet nonessential for an uninfected cell to survive. The present invention further provides several such cellular genes, as well as methods of treating viral infections by inhibiting the functioning of such genes.

As used herein, "replication" and "infection" can include any of the processes for viral success in a cell, e.g. infection, growth, replication, and lysis.

Furthermore, the present invention provides a method for isolation of cellular genes utilized in tumor progression.

The invention also provides cellular genes whose overexpression is associated with inhibition of viral growth and/or reproduction.

The present method provides several cellular genes that are necessary for viral growth in the cell but are not essential for the cell to survive. These genes are important for lytic and persistent infection by viruses. These genes were isolated by generating gene trap libraries by infecting cells with a retrovirus gene trap vector, selecting for cells in which a gene trap event occurred (i.e., in which the vector had inserted such that the promoterless marker gene was inserted such that a cellular promoter promotes transcription of the marker gene, i.e., inserted into a functioning gene), starving the cells of serum, infecting the selected cells with the virus of choice while continuing serum starvation, and adding back serum to allow visible colonies to develop, which colonies were cloned by limiting dilution. Genes into which the retrovirus gene trap vector inserted were then isolated from the colonies using probes specific for the retrovirus gene trap vector. Thus nucleic acids isolated by this method are isolated portions of genes. Additionally, utilizing this method, several cellular genes were isolated whose overexpression prevents viral infection or tumor growth, and they provide methods of treating viral infection or tumor growth/suppression by overexpression of these genes.

The present invention identifies the genomic loci of genes required for viral replication or responsible for a malignant phenotype by providing genomic sequences disrupted by the present gene trap method. Providing the sequence of the disrupted locus identifies the gene that is disrupted. Thus, the invention provides the gene at the locus disrupted by the present gene trap vector. By identifying the gene that is disrupted, the invention provides both the gene and its product(s) as targets for antiviral therapies.

As targets for anti-viral or anti-cancer therapies, the invention provides several examples of regulatory sequences (e.g., transcription factors). In some cases, disruption of the transcription factor has a direct impact on viral growth. In other cases disruption of the transcription factor affects viral growth by affecting transcription or translation of the gene or genes that are under its control. Examples of multi-gene pathways controlled by a transcription factor that is disrupted by the present vectors, such as the CTCF pathway, are provided herein.

Thus the present invention provides a method of identifying a cellular gene necessary for viral growth in a cell and nonessential for cellular survival, comprising (a) transferring into a cell culture growing in serum-containing medium a vector encoding a selective marker gene lacking a functional promoter, (b) selecting cells expressing the marker gene, (c) removing serum from the culture medium, (d) infecting the cell culture with the virus, and (e) isolating from the surviving cells a cellular gene within which the marker gene is inserted, thereby identifying a gene necessary for viral growth in a cell and nonessential for cellular survival. The present invention also provides a method of identifying a cellular gene used for viral growth in a cell and nonessential for cellular survival, comprising (a) transferring into a cell culture growing in serum-containing medium a vector encoding a selective marker gene lacking a functional promoter, (b) selecting cells expressing the marker gene, (c) removing serum from the culture medium, (d) infecting the cell culture with the virus, and (e) isolating from the surviving cells a cellular gene within which the marker gene is inserted, thereby identifying a gene necessary for viral growth in a cell and nonessential for cellular survival. In any selected cell type, such as Chinese hamster ovary cells, one can readily determine if serum starvation is required for selection. If it is not, serum starvation may be eliminated from the steps.

Thus the present invention provides a method of identifying a cellular gene necessary for viral growth in a cell and nonessential for cellular survival, comprising (a) transferring into a cell culture growing in serum-containing medium a vector encoding a selective marker gene lacking a functional promoter, (b) selecting cells expressing the marker gene, (c) infecting the cell culture with the virus, and (d) isolating from the surviving cells a cellular gene within which the marker gene is inserted, thereby identifying a gene necessary for viral growth in a cell and nonessential for cellular survival. The present invention also provides a method of identifying a cellular gene used for viral growth in a cell and nonessential for cellular survival, comprising (a) transferring into a cell culture growing in serum-containing medium a vector encoding a selective marker gene lacking a functional promoter, (b) selecting cells expressing the marker gene, (c) infecting the cell culture with the virus, and (d) isolating from the surviving cells a cellular gene within which the marker gene is inserted, thereby identifying a gene necessary for viral growth in a cell and nonessential for cellular survival.

Alternatively, instead of removing serum from the culture medium, a serum factor required by the virus for growth can be inhibited, such as by the administration of an antibody that specifically binds that factor. Furthermore, if it is believed that there are no or few persistently infected cells in the culture, the serum starvation step can be eliminated and the cells grown in usual medium for the cell type. Thus, the method can be used without regard for the serum survival factor where the virus is lylytic to the selection cell. If serum starvation is used, it can be continued for a time after the culture is infected with the virus. Serum can then be added back to the culture. If some other method is used to inactivate the factor, it can be discontinued, inactivated or removed (such as removing the anti-factor antibody, e.g., with a bound antibody directed against that antibody) prior to adding fresh serum back to the culture. Cells that survive are mutants having an inactivating insertion in a gene necessary for growth of the virus. The genes having the insertions can then be isolated by isolating sequences having the marker gene sequences. This mutational process disturbs a wild type function. A mutant gene may produce at a lower level a normal product, it may produce a normal product not normally found in these cells, it may cause the overproduction of a normal product, it may produce an altered product that has some functions but not others, or it may completely disrupt a gene function. Additionally, the mutation may disrupt an RNA that has a function but is never translated into a protein. For example, the alpha-tropomyosin gene has a 3' RNA that is very important in cell regulation but never is translated into protein. (*Cell* 75 pg 1107-1117, Dec. 17, 1993).

As used herein, a cellular gene "nonessential for cellular survival" means a gene for which disruption of one or both alleles results in a cell viable for at least a period of time which allows viral replication to be inhibited for preventative or therapeutic uses or use in research. A gene "necessary for viral growth" means the gene product, either protein or RNA, secreted or not, is necessary, either directly or indirectly in some way for the virus to grow, and therefore, in the absence of that gene product (i.e., a functionally available gene product), at least some of the cells containing the virus die. For example, such genes can encode cell cycle regulatory proteins, proteins affecting the vacuolar hydrogen pump, or proteins involved in protein folding and protein modification, including but not limited to: phosphorylation, methylation, glycosylation, myrislation or other lipid moiety, or protein processing via enzymatic processing. Some examples of such genes are exemplified herein, wherein some of the isolated nucleic acids correspond to genes such as vacuolar H+ATPase, alpha tropomyosin, gas5 gene, ras complex, N-acetyl-glucosaminyltransferase I mRNA, and calcyclin.

Any virus capable of infecting the cell can be used for this method. Virus can be selected based upon the particular infection desired to study. However, it is contemplated by the present invention that many viruses will be dependent upon the same cellular genes for survival; thus a cellular gene isolated using one virus can be used as a target for therapy for other viruses as well. All viruses that can be sorted using lytic infection, or that can be selected through multiple rounds of robotic infection (if the cell line is not totally lytic), can be sorted against PI cells by using multiple rounds of selection in the same library. During this process the inserts in PI cells should be random, unless the disrupted gene is important for the establishment of the PI state. Other genes selected should be in cells that are resistant to infection; thus, this process is facilitated by robotic selection, as multiple rounds of selection can be achieved.

Any cellular gene can be tested for relevancy to any desired virus using the methods set forth herein, i.e., in general, by inhibiting the gene or its gene product in a cell and determining if the desired virus can grow in that cell. Some examples of viruses include HIV (including HIV-1 and HIV-2); parvovirus; papillomaviruses; SARS (severe acute respiratory syndrome) virus; hantaviruses; influenza viruses (e.g., influenza A, B and C viruses); hepatitis viruses A to G; caliciviruses; astroviruses; rotaviruses; coronaviruses, such as human respiratory coronavirus; picornaviruses, such as human rhinovirus and enterovirus; ebola virus; human herpesvirus (e.g., HSV-1-9) including zoster, epstein-bar, and human cytomegalovirus; human cytomegalovirus; human adenovirus; hantaviruses; for animal, the animal counterpart to any above listed human virus, animal retroviruses, such as simian immunodeficiency virus, avian immunodeficiency virus, bovine immunodeficiency virus, feline immunodeficiency virus, equine infectious anemia virus, caprine arthritis encephalitis virus or visna virus.

The methods of the present invention can be used to identify and target bacteria. Examples of bacteria that can be targeted include, but are not limited to, the following: *Listeria* (sp.), *Mycobacterium tuberculosis, Ricketsia* (all types), *Ehrlichia, Clrylamida*. Further examples of bacteria that can be targeted by the present methods include *M. tuberculosis, M. bovis, M. bovis* strain BCG, BCG substrains, *M. avium, M. intracellulare, M. africanum, M. kansasii, M. marinum, M. ulcerans, M. avium* subspecies *paratuberculosis, Nocardia asteroides*, other *Nocardia* species, *Legionella pneumophila*, other *Legionella* species, *Salmonella typhi*, other *Salmonella* species, *Shigella* species, *Yersinia pestis, Pasteurella haemolytica, Pasteurella multocida*, other *Pasteurella* species, *Actinobacillus pleuropneumoniae, Listeria monocytogenes, Listeria ivanovii, Brucella abortus*, other *Brucella* species, *Cowdria ruminantiumn, Chlamydia pneumoniae, Chlamydia trachomatis, Chlamydia psittaci, Coxiella burnetti*, other *Ricketsial* species, *Ehrlichia* species, *Staphylococcus aureus, Staphylococcus epidermidis, Streptococcus pyogenes, Streptococcus agalactiae, Bacillus anthracis, Escherichia coli, Vibrio cholerae, Campylobacter* species, *Neiserria meningitidis, Neiserria gonorrhea, Pseudomonas aeruginosa*, other *Pseudomonas* species, *Haemophilus influenzae, Haemophilus ducreyi*, other *Hemophilus* species, *Clostridium tetani*, other *Clostridium* species, *Yersinia enterolitica*, and other *Yersinia* species.

The methods of the present invention can be used to identify and target parasites. Examples of parasites that can be targeted include, but are not limited to, the following: *Cryptosporidium, Plasmodium* (all species), American trypanosomes (*T. cruzi*). Furthermore, examples of protozoan and fungal species contemplated within the present methods include, but are not limited to, *Plasmodium falciparum*, other *Plasmodium* species, *Toxoplasma gondii, Pneumocystis carinii, Trypanosoma cruzi*, other trypanosomal species, *Leishmania donovani*, other *Leishmania* species, *Theileria annulata*, other *Theileria* species, *Eimeria tenella*, other *Eimeria* species, *Histoplasma capsulatum, Cryptococcus neoformans, Blastomyces dermatitidis, Coccidioides inumitis, Paracoccidioides brasiliensis, Pneumocystis carinii, Penicillium marneffei*, and *Candida* species.

The nucleic acids comprising cellular genes of this invention were isolated by the above method and as set forth in the examples. The invention includes a nucleic acid comprising the nucleotide sequence set forth in SEQ ID NO: 1, SEQ ID NO: 2, SEQ ID NO: 3, SEQ ID NO: 4, SEQ ID NO:5, SEQ ID NO:6, SEQ BD NO:7, SEQ ID NO:8, SEQ ID NO:9, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:31, SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ HD NO:49, SEQ ID NO:50, SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74 or SEQ ID NO:75, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 93, SEQ ID NO: 94, SEQ ID NO:95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 113, SEQ ID NO: 114 SEQ ID NO: 115, SEQ ID NO: 116, SEQ ID NO: 117, SEQ ID NO: 118, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO147, SEQ ID NO: 148, SEQ ID NO: 149, SEQ ID NO: 150, SEQ ID NO: 151, SEQ ID NO: 152, SEQ ID NO: 153, SEQ ID NO: 154 SEQ ID NO: 155, SEQ ID NO:156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO:175, SEQ ID NO: 176, SEQ ID SEQ ID NO: 178, SEQ ID NO: 179, SEQ ID NO: 180, SEQ ID NO: 181, SEQ ID NO: 182, SEQ ID NO: 183, SEQ ID NO:184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO:215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO:224, SEQ ID NO: 225, SEQ ID NO: 226, SEQ ID NO: 227, SEQ ID NO: 228, SEQ ID NO: 229, SEQ ID NO: 230, SEQ ID NO:231, SEQ ID NO: 232, SEQ ID NO: 233, SEQ ID NO: 234 SEQ ID NO: 235, SEQ ID NO: 236, SEQ ID NO: 237, SEQ ID NO: 238, SEQ ID NO: 239, SEQ ID NO: 241, SEQ ID NO: 242, SEQ ID NO: 244, SEQ ID NO: 245, SEQ ID NO:246, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO:255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO:264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274 SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO:295, SEQ ID NO: 296, SEQ ID NO: 297, SEQ ID NO: 298, SEQ ID NO299, SEQ ID NO: 300, SEQ ID NO: 301, SEQ ID NO: 302, SEQ ID NO: 303, SEQ ID NO:304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314 SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 332, SEQ ID NO: 333, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO:344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354 SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO:375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO383, SEQ ID NO:384, SEQ ID NO: 385, SEQ ID NO: 386, SEQ ID NO: 387, SEQ ID NO: 388, SEQ ID NO: 389, SEQ ID NO: 390, SEQ ID NO: 391, SEQ ID NO: 392, SEQ ID NO: 393, SEQ ID NO: 394 SEQ ID NO: 395, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 409, SEQ ID NO: 410, SEQ ID NO:415, SEQ ID NO: 416, SEQ ID NO: 417, SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO:425, SEQ ID NO: 426, SEQ ID NO: 427 SEQ ID NO: 428 (this list is sometimes referred to herein as SEQ ID LIST I for brevity). Thus these nucleic acids can contain, in addition to the nucleotides set forth in each SEQ ID NO in the sequence listing, additional nucleotides at either end of the molecule. Such additional nucleotides can be added by any standard method, as known in the art, such as recombinant methods and synthesis methods. Examples of such nucleic acids comprising the nucleotide sequence set forth in any entry of the sequence listing contemplated by this invention include, but are not limited to, for example, the nucleic acid placed into a vector; a nucleic acid having one or more regulatory region (e.g., promoter, enhancer, polyadenylation site) linked to it, particularly in functional manner, i.e. such that an mRNA or a protein can be produced; a nucleic acid including additional nucleic acids of the gene, such as a larger or even full length genomic fragment of the gene, a partial or full length cDNA, a partial or full length RNA. Making and/or isolating such larger nucleic acids is further described below and is well known and standard in the art.

The invention also provides a nucleic acid encoding the protein encoded by the gene comprising the nucleotide sequence set forth in SEQ ID NO: 1 to 428 (SEQ ID List 1), as well as allelic variants and homologs of each such gene. The gene is readily obtained using standard methods, as described below and as is known and standard in the art. The present invention also contemplates any unique fragment of these genes or of the nucleic acids set forth in any of the sequences listed in SEQ ID LIST 1. Examples of inventive fragments of the inventive genes are the nucleic acids whose sequence is set forth in any of the sequences set forth in SEQ ID LIST 1 (SEQ IDs 1-428). To be unique, the fragment must be of sufficient size to distinguish it from other known sequences, most readily determined by comparing any nucleic acid fragment to the nucleotide sequences of nucleic acids in computer databases, such as GenBank. Such comparative searches are standard in the art. Typically, a unique fragment useful as a primer or probe will be at least about 20 to about 25 nucleotides in length, depending upon the specific nucleotide content of the sequence. Additionally, fragments can be, for example, at least about 30, 40, 50, 75, 100, 200 or 500 nucleotides in length. The nucleic acids can be single or double stranded, depending upon the purpose for which it is intended.

The present invention further provides a nucleic acid comprising the regulatory region of a gene comprising the nucleotide sequences set forth in SEQ ID NO: 1 to 428 (SEQ ID List 1). Additionally provided is a construct comprising such a regulatory region functionally linked to a reporter gene. Such reporter gene constructs can be used to screen for compounds and compositions that affect expression of the gene comprising the nucleic acids whose sequence is set forth in any of the sequences listed above or in SEQ ID LIST 1.

The nucleic acids set forth in the sequence listing are typically gene fragments; the entire coding sequence and the entire gene that comprises each fragment are both contemplated herein and are readily obtained by standard methods, given the nucleotide sequences presented in the sequence listing (see, e.g., Sambrook et al., *Molecular Cloning: A Laboratory Manual,* 2nd Ed., Cold Spring Harbor Laboratory, Cold Spring Harbor, N.Y., 1989; *DNA cloning: A Practical Approach,* Volumes I and II, Glover, D. M. ed., IRL Press Limited, Oxford, 1985)., To obtain the entire genomic gene, briefly, a nucleic acid whose sequence is set forth in any of the sequences set forth above, or a smaller fragment thereof, is utilized as a probe to screen a genomic library under high stringency conditions, and isolated clones are sequenced. Therefore, once a genomic locus has been disrupted by the methods of the present invention, and a partial sequence for the disrupted gene is obtained, one of skilled in the art would know how to isolate the entire gene comprising the partial sequence and thus would be in possession of the full length sequence of the gene, including its regulatory regions. For example, once the sequence of the new clone is determined, a probe can be devised from a portion of the new clone not present in the previous fragment and hybridized to the library to isolate more clones containing fragments of the gene. In this manner, by repeating this process in organized fashion, one can "walk" along the chromosome and eventually obtain nucleotide sequence for the entire gene. Similarly, one can use portions of the present fragments, or additional fragments obtained from the genomic library, that contain open reading frames to screen a cDNA library to obtain a cDNA having the entire coding sequence of the gene. Repeated screens can be utilized as described above to obtain the complete sequence from several clones if necessary. The isolates can then be sequenced to determine the nucleotide sequence by standard means such as dideoxynucleotide sequencing methods (see, e.g., Sambrook et al., *Molecular Cloning: A Laboratory Manual,* 2nd Ed., Cold Spring Harbor Laboratory, Cold Spring Harbor, N.Y., 1989).

The present genes were isolated from rat; however, homologs in any desired species, preferably mammalian, such as human, are provided or can readily be obtained by screening a human library, genomic or cDNA, with a probe comprising sequences of the nucleic acids set forth in the sequence listing herein, or fragments thereof, and isolating genes specifically hybridizing with the probe under preferably relatively high stringency hybridization conditions. For example, high salt conditions (e.g., in 6×SSC or 6×SSPE) and/or high temperatures of hybridization can be used. For example, the stringency of hybridization is typically about 5° C. to 20° C. below the $T_m$ (the melting temperature at which half of the molecules dissociate from its partner) for the given chain length. As is known in the art, the nucleotide composition of the hybridizing region factors in determining the melting temperature of the hybrid. For 20 mer probes, for example, the recommended hybridization temperature is typically about 55-58° C. Additionally, the rat sequence can be utilized to devise a probe for a homolog in any specific animal by determining the amino acid sequence for a portion of the rat protein, and selecting a probe with optimized codon usage to encode the amino acid sequence of the homolog in that particular animal. Any isolated gene can be confirmed as the targeted gene by sequencing the gene to determine it contains the nucleotide sequence listed herein as comprising the gene. Any homolog can be confirmed as a homolog by its functionality. Homologs can also be obtained by comparing the rat sequences to sequences from other species on readily available databases. For example, the rat sequence can be compared with mouse sequences to obtain a homolog. The homolog obtained from this comparison can then be compared to human sequences or other mammalian sequences to obtain additional homologs. The rat sequences can also be compared directly with human sequences or any other mammalian sequences on databases.

Additionally contemplated by the present invention are nucleic acids, from any desired species, preferably mammalian and more preferably human, having 98%, 95%, 90%, 85%, 80%, 70%, 60%, or 50% homology, or greater, in the region of homology, to a region in an exon of a nucleic acid encoding the protein encoded by the gene comprising the nucleotide sequence set forth in any of SEQ ID NO:1 through SEQ ID 428 of the sequence listing or to homologs thereof. Also contemplated by the present invention are nucleic acids, from any desired species, preferably mammalian and more preferably human, having 98%, 95%, 90%, 85%, 80%, 70%, 60%, or 50% homology, or greater, in the region of homology, to a region in an exon of a nucleic acid comprising the nucleotide sequence set forth in any of SEQ ID NO:1 through SEQ ID 418 of the sequence listing or to homologs thereof. These genes can be synthesized or obtained by the same methods used to isolate homologs, with stringency of hybridization and washing, if desired, reduced accordingly as homology desired is decreased, and further, depending upon the G-C or A-T richness of any area wherein variability is searched for. Allelic variants of any of the present genes or of their homologs can readily be isolated and sequenced by screening additional libraries following the protocol above. Methods of making synthetic genes are described in U.S. Pat. No. 5,503, 995 and the references cited therein.

The nucleic acid encoding any selected protein of the present invention can be any nucleic acid that functionally encodes that protein. For example, to functionally encode, i.e., allow the nucleic acid to be expressed, the nucleic acid can include, for example, exogenous or endogenous expression control sequences, such as an origin of replication, a promoter, an enhancer, and necessary information processing sites, such as ribosome binding sites, RNA splice sites, polyadenylation sites, and transcriptional terminator sequences. Preferred expression control sequences can be promoters derived from metallothionine genes, actin genes, immunoglobulin genes, CMV, SV40, adenovirus, bovine papilloma virus, etc. Expression control sequences can be selected for functionality in the cells in which the nucleic acid will be placed. A nucleic acid encoding a selected protein can readily be determined based upon the amino acid sequence of the selected protein, and, clearly, many nucleic acids will encode any selected protein.

The present invention additionally provides a nucleic acid that selectively hybridizes under stringent conditions with a nucleic acid encoding the protein encoded by the gene comprising the nucleotide sequence set forth in any sequence listed herein (i.e., any of SEQ ID NO:1 through SEQ ID NO:428). This hybridization can be specific. The degree of complementarity between the hybridizing nucleic acid and the sequence to which it hybridizes should be at least enough to exclude hybridization with a nucleic acid encoding an unrelated protein. Thus, a nucleic acid that selectively hybridizes with a nucleic acid of the present protein coding sequence will not selectively hybridize under stringent conditions with a nucleic acid for a different, unrelated protein, and vice versa. Typically, the stringency of hybridization to achieve selective hybridization involves hybridization in high ionic strength solution (6×SSC or 6×SSPE) at a temperature that is about 12-25° C. below the $T_m$ (the melting temperature at which half of the molecules dissociate from its partner) followed by washing at a combination of temperature and salt concentration chosen so that the washing temperature is about 5° C. to 20° C. below the $T_m$ of the hybrid molecule. The temperature and salt conditions are readily determined empirically in preliminary experiments in which samples of reference DNA immobilized on filters are hybridized to a labeled nucleic acid of interest and then washed under conditions of different stringencies. Hybridization temperatures are typically higher for DNA-RNA and RNA-RNA hybridizations. The washing temperatures can be used as described above to achieve selective stringency, as is known in the art. (Sambrook et al., *Molecular Cloning: A Laboratory Manual*, 2nd Ed., Cold Spring Harbor Laboratory, Cold Spring Harbor, N.Y., 1989; Kunkel et al. *Methods Enzymol.* 1987:154: 367, 1987). Nucleic acid fragments that selectively hybridize to any given nucleic acid can be used, e.g., as primers and or probes for further hybridization or for amplification methods (e.g., polymerase chain reaction (ICR), ligase chain reaction (LCR)). A preferable stringent hybridization condition for a DNA:DNA hybridization can be at about 68° C. (in aqueous solution) in 6×SSC or 6×SSPE followed by washing at 68° C.

The present invention additionally provides a protein encoded by a nucleic acid encoding the protein encoded by the gene comprising any of the nucleotide sequences set forth herein (i.e., any of SEQ ID NO: 1 through SEQ ID NO:428). The protein can be readily obtained by any of several means. For example, the nucleotide sequence of coding regions of the gene can be translated and then the corresponding polypeptide can be synthesized mechanically by standard methods. Additionally, the coding regions of the genes can be expressed or synthesized, an antibody specific for the resulting polypeptide can be raised by standard methods (see, e.g., Harlow and Lane, *Antibodies: A Laboratory Manual*, Cold Spring Harbor Laboratory, Cold Spring Harbor, N.Y., 1988), and the protein can be isolated from other cellular proteins by selective hybridization with the antibody. This protein can be purified to the extent desired by standard methods of protein purification (see, e.g., Sambrook et al., *Molecular Cloning: A Laboratory Manual*, 2nd Ed., Cold Spring Harbor Laboratory, Cold Spring Harbor, N.Y., 1989). The amino acid sequence of any protein, polypeptide or, peptide of this invention can be deduced from the nucleic acid sequence, or it can be determined by sequencing an isolated or recombinantly produced protein.

The terms "peptide," "polypeptide" and "protein" are used interchangeably herein and refer to a polymer of amino acids and includes full-length proteins and fragments thereof. As used in the specification and in the claims, "a" can mean one or more, depending upon the context in which it is used. An amino acid residue is an amino acid formed upon chemical digestion (hydrolysis) of a polypeptide at its peptide linkages. The amino acid residues described herein are preferably in the L isomeric form. However, residues in the D-isomeric form can be substituted for any L-amino acid residue, as long as the desired functional property is retained by the polypeptide. Standard polypeptide nomenclature (described in *J. Biol. Chem.*, 243:3552-59 (1969) and adopted at 37 CFR §1.822(b)) is used herein.

As will be appreciated by those skilled in the art, the invention also includes those polypeptides having slight variations in amino acid sequences or other properties. Amino acid substitutions can be selected by known parameters to be neutral (see, e.g., Robinson W E Jr, and Mitchell W M., AIDS 4:S151-S162 (1990)). Such variations may arise naturally as allelic variations (e.g., due to genetic polymorphism) or may be produced by human intervention (e.g., by mutagenesis of cloned DNA sequences), such as induced point, deletion, insertion and substitution mutants. Minor changes in amino acid sequence are generally preferred, such as conservative amino acid replacements, small internal deletions or insertions, and additions or deletions at the ends of the molecules. Substitutions may be designed based on, for example, the model of Dayhoff, et al. (in *Atlas of protein Sequence and Structure* 1978, Nat'l Biomed. Res. Found., Washington, D.C.). These modifications can result in changes in the amino acid sequence, provide silent mutations, modify a restriction site, or provide other specific mutations. Likewise, such amino acid changes result in a different nucleic acid encoding the polypeptides and proteins. Thus, alternative nucleic acids are also contemplated by such modifications.

The present invention also provides cells containing a nucleic acid of the invention. A cell containing a nucleic acid encoding a protein typically can replicate the DNA and, further, typically can express the encoded protein. The cell can be a prokaryotic cell, particularly for the purpose of producing quantities of the nucleic acid, or a eukaryotic cell, particularly a mammalian cell. The cell is preferably a mammalian cell for the purpose of expressing the encoded protein so that the resultant produced protein has mammalian protein processing modifications.

Nucleic acids of the present invention can be delivered into cells by any selected means, in particular depending upon the purpose of the delivery of the compound and the target cells. Many delivery means are well-known in the art. For example, electroporation, calcium phosphate precipitation, microinjection, cationic or anionic liposomes, and liposomes in combination with a nuclear localization signal peptide for delivery to the nucleus can be utilized, as is known in the art.

The present invention also contemplates that the mutated cellular genes necessary for viral growth, produced by the present method, as well as cells containing these mutants can also be useful. These mutated genes and cells containing them can be isolated and/or produced according to the methods herein described and using standard methods.

It should be recognized that the sequences set forth herein may contain minor sequencing errors. Such errors can be corrected, for example, by using the hybridization procedure described above with various probes derived from the described sequences such that the coding sequence can be reisolated and resequenced.

As described in the examples, the present invention provides the discovery of a "serum survival factor" present in serum that is necessary for the survival of certain persistently virally infected cells. Isolation and characterization of this factor have shown it to be a protein, to have a molecular weight of between about 50 kD and 100 kD, to resist inactivation in low pH (e.g., pH2) and chloroform extraction, to be inactivated by boiling for about 5 minutes and in low ionic strength solution (e.g., about 10 mM to about 50 mM). The present invention thus provides a purified mammalian serum protein having a molecular weight of between about 50 kD and 100 kD which resists inactivation in low pH and resists inactivation by chloroform extraction, which inactivates when boiled and inactivates in low ionic strength solution, and which when removed from a cell culture comprising cells persistently infected with reovirus selectively substantially prevents survival of cells persistently infected with reovirus. The factor, fitting the physical characteristics described above, can readily be verified by adding it to non-serum-containing medium (which previously could not support survival of persistently virally infected cells) and determining whether this medium with the added putative factor can now support persistently virally infected cells, particularly cells persistently infected with reovirus. As used herein, a "purified" protein means the protein is at least of sufficient purity such that an approximate molecular weight can be determined.

The amino acid sequence of the protein can be elucidated by standard methods. For example, an antibody to the protein can be raised and used to screen an expression library to obtain nucleic acid sequence coding the protein. This nucleic acid sequence is then simply translated into the corresponding amino acid sequence. Alternatively, a portion of the protein can be directly sequenced by standard amino acid sequencing methods (amino-terminus sequencing). This amino acid sequence can then be used to generate an array of nucleic acid probes that encompasses all possible coding sequences for a portion of the amino acid sequence. The array of probes is used to screen a cDNA library to obtain the remainder of the coding sequence and thus ultimately the corresponding amino acid sequence.

The present invention also provides methods of detecting and isolating additional serum survival factors. For example, to determine if any known serum components are necessary for viral growth, the known components can be inhibited in, or eliminated from, the culture medium, and it can be observed whether viral growth is inhibited by determining if persistently infected cells do not survive. One can add the factor back (or remove the inhibition) and determine whether the factor allows for viral growth.

Additionally, other, unknown serum components can also be found to be essential for viral growth. Serum can be fractionated by various standard means, and fractions added to serum free medium to determine if a factor is present in a reaction that allows viral growth previously inhibited by the lack of serum. Fractions having this activity can then be further fractionated until the factor is relatively free of other components. The factor can then be characterized by standard methods, such as size fractionation, denaturation and/or inactivation by various means, etc. Preferably, once the factor has been purified to a desired level of purity, it is added to cells in serum free medium to confirm that it bestows the function of allowing virus to grow when serum-free medium alone did not. This method can be repeated to confirm the requirement for the specific factor for any desired virus, since each serum factor found to be required by any one virus can also be required by many other viruses. In general, the closer the viruses are related and the more similar the infection modes of the viruses, the more likely that a factor required by one virus will be required by the other.

The present invention also provides methods of treating virus infections utilizing applicants' discoveries. The subject of any of the herein described methods can be any animal, preferably a mammal, such as a human, a veterinary animal, such as a cat, dog, horse, pig, goat, sheep, or cow, or a laboratory animal, such as a mouse, rat, rabbit, or guinea pig, depending upon the virus.

The present invention provides a method of reducing or inhibiting, and thereby treating, a viral infection in a subject, comprising administering to the subject an inhibiting amount of a composition that inhibits functioning of the serum protein described herein, i.e. the serum protein having a molecular weight of between about 50 kD and 100 kD which resists inactivation in low pH and resists inactivation by chloroform extraction, which inactivates when boiled and inactivates in low ionic strength solution, and which when removed from a cell culture comprising cells persistently infected with the virus prevents survival of at least some cells persistently infected with the virus, thereby treating the viral infection. The composition can comprise, for example, an antibody that specifically binds the serum protein, or an antisense RNA that binds an RNA encoded by a gene functionally encoding the serum protein.

The method of reducing or inhibiting viral infection in a subject, can use a vector that is targeted to one of the genes (or loci) identified herein as associate with viral growth (e.g., SEQ ID NOS: 1-428). The method call for administration of a vector targeted to the sequence, whereby the vector can disrupt the gene and thereby inhibit the viral growth that is dependent on the disrupted gene. The vector can be targeted by containing homologous sequences such that an insertional or deletional mutation takes place at the target site upon administration of the vector.

Any virus capable of infecting the selected subject to be treated can be treated by the present method. As described above, any serum protein or survival factor found by the present methods to be necessary for growth of any one virus can be found to be necessary for growth of many other viruses. For any given virus, the serum protein or factor can be confirmed to be required for growth by the methods described herein. The cellular genes identified by the examples using reovirus, a mammalian pathogen, and a rat cell system have general applicability to other virus infections that include all of the known as well as yet to be discovered human pathogens, including, but not limited to: human immunodeficiency viruses (e.g., HIV-1, HIV-2); parvovirus; papillomaviruses; hantaviruses; SARS (severe acute respiratory syndrome) virus influenza viruses (e.g., influenza A, B and C viruses);, hepatitis viruses A to G; caliciviruses; astroviruses; rotaviruses; coronaviruses, such as human respiratory coronavirus; picornaviruses, such as human rhinovirus and enterovirus; ebola virus; human herpesvirus (e.g., HSV-1-9); human cytomegalovirus; human adenovirus; Epstein-Barr virus; hantaviruses; for animal, the animal counterpart to any above listed human virus, animal retroviruses, such as simian immunodeficiency virus, avian immunodeficiency virus, bovine immunodeficiency virus, feline immunodeficiency virus, equine infectious anemia virus, caprine arthritis encephalitis virus or visna virus.

A protein inhibiting amount of the composition can be readily determined, such as by administering varying amounts to cells or to a subject and then adjusting the effective amount for inhibiting the protein according to the volume of blood or weight of the subject. Compositions that bind to the protein can be readily determined by running the putatively bound protein on a protein gel and observing an alteration in the protein's migration through the gel. Inhibition of the protein can be determined by any desired means such as adding the inhibitor to complete media used to maintain persistently infected cells and observing the cells' viability. The composition can comprise, for example, an antibody that specifically binds the serum protein. Specific binding by an antibody means that the antibody can be used to selectively remove the factor from serum or inhibit the factor's biological activity and can readily be determined by radio immune assay (RIA), bioassay, or enzyme-linked immunosorbant (ELISA) technology.

The identification of cellular genes that are associated with the propogation of intracellular pathogens allows for effective targeting at the level of transcription, translation, processing, or protein function (phosphorylation, glycosylation, protein-protein interactions, etc.). There are examples of each. Many of these are aimed at the viral proteins or their untranslated DNA, or RNA. As there is greater genetic instability in the pathogen that the host, these targets are more prone to mutation and escape from the effect of the therapeutic approach. Host targets are more likely to be stable and therefore may be more practical, if the target is not conditionally lethal when mutant. As the process of selection utilized in the approach taken in this patent relies upon cellular proliferation after the mutation has been made, the target for a therapeutic is unlikely to be lethal when mutant. Thus, the composition can comprise, for example, an antisense RNA or an siRNA (small interfering RNA (siRNA)) that specifically binds an RNA encoded by the gene encoding the serum protein. Antisense RNAs can be synthesized and used by standard methods (e.g., *Antisense RNA and DNA*, D. A. Melton, Ed., Cold Spring Harbor Laboratory, Cold Spring Harbor, N.Y. (1988)).

Antisense molecules against nucleic acids encoding the ANNEXIN I, ANNEXIN II and ANNEXIN III proteins are provided and can be used to inhibit the expression of the targeted protein. As will be understood by those of skill in the art, antisense molecules are oligonucleotides that are complements or partial complements to nucleic acid sequence that encodes or is necessary for the expression of the protein whose expression is to be inhibited. For example, antisense molecules that can be used to inhibit the expression of these proteins include any oligonucleotide that is complementary to the nucleic acid encoding the particular protein. For example, for inhibiting the expression of ANNEXIN I, an antisense oligonucleotide complementary or partially complementary to, but not limited to, SEQ ID NO: 65 or a portion thereof can be used to inhibit ANNEXIN I expression. Particular antisense oligonucleotides can form duplexes that persist at an appreciable level, thereby reducing the expression of the targeted gene, under selected conditions. Examples of antisense targeting ANNEXIN I protein expression can include an oligonucleotide comprising the complement of SEQ ID NO:65 or portions of the complement to SEQ ID NO:65. Particular examples of such antisense molecules for ANNEXIN I protein would include; AACAAGTCAAATGCT (SEQ ID NO: 431), AACAAGTCAAATGCTTTATA (SEQ ID NO: 432), GTCAAATGCTTTATA (SEQ ID NO: 433), TTATATATTTGAGT T (SEQ ID NO: 434), TTATATATTTGAGTTAGGGA (SEQ ID NO: 435), TTTGAGTTAGGGAACATGTATAT (SEQ ID NO: 436), CATGTATATGTCAAAAATAAAAAT (SEQ ID NO: 437), TGCACATTGAAACCCTTATG (SEQ ID NO: 438), TTC-CACGTTTATCTATTTT (SEQ ID NO: 439), and GGAAACGTTAATGACAGAAAC (SEQ ID NO: 440). Similarly, for inhibiting the expression of ANNEXIN II protein, antisense molecules that inhibit the expression of ANNEXIN II protein can include any oligonucleotide that is complementary to the nucleic acid encoding ANNEXIN II protein such as, but not limited to, SEQ ID NO: 41. Particular examples of such antisense molecules for ANNEXIN II protein would include; AAAAGGCGGACAAGGG (SEQ ID NO: 441), CTTCCNGACNCCCCNAAGCC (SEQ ID NO: 442), CGAANCGGAAGGGC (SEQ ID NO: 443), GCCCGCCCGAA (SEQ ID NO: 444), GGCCGACTCTCT-GCCCGCC (SEQ ID NO: 445), and CCCGGAAAGAGGA-CAGCG (SEQ ID NO: 446).

Similarly, for inhibiting the expression of ANNEXIN III protein, antisense molecules that inhibit the expression of ANNEXIN III protein can include any oligonucleotide that is complementary to the nucleic acid encoding ANNEXIN II protein such as, but not limited to, SEQ ID NO: 188. Particular examples of such antisense molecules for ANNEXIN III protein would include; GGTTGGGCCAAAAA (SEQ ID NO: 447), TTAANAAACCGTTCACCCC SE ID NO: 448), AACCGGTGGTTTGTTGCCGG (SEQ ID NO: 449), GATAACTCACTGCTG (SEQ ID NO: 450), CTTCTCT-TGAACACACCTCCTGGGG (SEQ ID NO: 451, and GCGAAAGGCCCTAACAATAG (SEQ ID NO: 452).

Similarly, for any other protein encoding genes, such as, but not limited to, the IGF2BP 5 protease (prss11) genes, antisense molecules can be designed as is illustrated above for the ANNEXIN I, II and III proteins by those of skill in the art. For example, the antisense molecule to be used can be greater than 14, 15, 16, 17, 18, 20, 22, 24, 26, 28, 30, 34, 38, 42, 50, 60, 70, 80 or 90 nucleotides in length. The antisense molecule to be used can be less than 150, 125, 100, 90, 80, 70, 60, 50, 42, 38, 34, 30, 28, 26, 24, 22, 20, 18, 17, 16, or 15 nucleotides in length. Antisense molecules can include mismatches or non-Watson-Crick base pairings with the target sequence of the targeted gene. The number of mismatches can be greater than 0, 1, 2, 3, 4, 5, 6, 7, 8, 9, 10, 12, 14, 16, 18 or 20 nucleotides. The number of mismatches can be less than 20, 18, 16, 14, 12, 10, 9, 8, 7, 6, 5, 4, 3, 2 or 1 nucleotides. The level of mismatches in the sequence of the antisense molecule can be more than 0.5, 1, 2, 3, 4, 5, or 7% of the total number of base pairs. The level of mismatches in the sequence of the antisense molecule can be less than 10, 7, 5, 4, 3, 2, or 1% of the total number of base pairs. Further, antisense sequences can include further contiguous sequence on either the 5' or 3' ends of the molecules in addition to that corresponding to complementary or partially complementary sequence as described herein. For example, an antisense molecule can be linked to further sequence that is not a complement to the target sequence.

In other embodiments, oligonucleotides that function in a manner different from antisense can be used. For example, an RNA for use as an interfering RNA such as siRNA can be designed based on the sequence of the encoded protein whose expression is to be inhibited or reduced. The resulting interfering RNA can be used in a manner similar to that of the antisense molecules to reduce or inhibit the expression of particular proteins such as, but not limited to, those described herein, particularly those noted in the Table 2 and their human homologs. The following references relating to the phenomenon of RNA interference and its use to silence gene expression are incorporated herein for their teachings, particularly their teachings of how to silence expression of genes, putative genes, or potential genes, by transfecting or transforming cells with RNA molecules; Fire et al., "Potent and specific genetic interference by double-stranded RNA in *Caenorhabditis elegans*," *Nature* 391: 806-811 (1998); Kennerdell and Carthew, "Use of dsRNA-mediated interference to demonstrate that frizzled and frizzled 2 act in the wingless pathway," *Cell* 95: 1017-1026 (1998); Ngo et al., "Double-stranded RNA induces mRNA degradation in *Trypanosoma brucei*," *Proc. Natl. Acad. Sci. USA* 95: 14687-14692 (1998); Timmons and Fire, "Specific interference by ingested dsRNA," *Nature* 395: 854 (1998); Yang et al., "Specific double-stranded RNA interference in undifferentiated mouse embryonic stem cells," *Mol. Cell. Biol.* 21: 7807-7816 (2001); Caplen et al., "Specific inhibition of gene expression by small double-stranded RNAs in invertebrate and vertebrate systems," *Proc. Natl. Acad. Sci. USA* 98: 9742-9747 (2001); Elbashir et al., "Duplexes of 21-nucleotide RNAs mediate RNA interference in mammalian cell culture," *Nature* 411: 494-498 (2001); Hammond et al., "An RNA-directed nuclease mediates post-transcriptional gene silencing in *Drosophila* cells," *Nature* 404: 293-296 (2000); Zamore et al., "RNAi:double-stranded RNA directs the ATP-dependent cleavage of mRNA at 21-33 nucleotide intervals," *Cell* 101: 25-33 (2000); Bernstein et al., "Role for a bidentate ribonuclease in the initiation step of RNA interference," *Nature* 409: 363-366 (2001); Nykanen et al., "ATP requirements and small interfering RNA structure in the RNA interference pathway," *Cell* 107: 309-321 (2001); Elbashir et al., "RNA interference is mediated by 21 and 22-nucleotide RNAs," *Genes Dev.* 15:188-200 (2001); Lipardi et al., "RNAi as random degradative PCR, siRNA primers convert mRNA into dsRNAs that are degraded to generate new siRNAs," *Cell* 107: 297-307 (2001); Sijen et al., "On the role of RNA amplification in dsRNA-triggered gene silencing," *Cell* 107: 465-476 (2001); Grishok et al., "Genes and mechanisms related to RNA interference regulate expression of the small temporal RNAs that control *C. elegans* developmental tiring," *Cell* 106: 23-34 (2001); Aravin et al., "Double-stranded RNA-mediated silencing of genomic tandem repeats and transposable elements in the *D. melanogaster* germline," *Curr. Biol.* 11: 1017-1027 (2001); and Hutvagner and Zamore, "RNAi: nature abhors a double-strand," Curr. Opinion Genetics Develop. 12: 225-232 (2002). Examples of effective therapies include the following.

CCR5 has a target for siRNA. CCR5 is a co-receptor (cellular gene product) necessary for HIV entry into macrophage cell lines (Qin X F, An D S, Chen I S, Baltimore D., Inhibiting HIV-1 infection in human T cells by lentiviral-mediated delivery of small interfering RNA against CCR5, Proc Natl Acad Sci USA 2003 Jan. 7; 100(1): 183-8). Double-stranded RNAs, approximately 21 nucleotides long, are recognized as powerful reagents to reduce the expression of specific genes. To use them as reagents to protect cells against viral infection, effective methods for introducing siRNAs into primary cells are required. Here, we describe success in constructing a lentivirus-based vector to introduce siRNAs against the HIV-1 coreceptor, CCR5, into human peripheral blood T lymphocytes. With high-titer vector stocks, >40% of the peripheral blood T lymphocytes could be transduced, and the expression of a potent CCR5-siRNA resulted in up to 10-fold inhibition of CCR5 expression on the cell surface over a period of 2 weeks in the absence of selection. In contrast, the expression of another major HIV-1 coreceptor, CXCR4, was not affected. Importantly, blocking CCR5 expression by siRNAs provided a substantial protection for the lymphocyte populations from CCR5-tropic HIV-1 virus infection, dropping infected cells by 3- to 7-fold; only a minimal effect on infection by a CXCR4-tropic virus was observed. Thus, our studies demonstrate the feasibility and potential of lentiviral vector-mediated delivery of siRNAs as a general means of intracellular immunization for the treatment of HIV-1 and other viral diseases.

A viral target for Influenza A: Ge Q, McManus M T, Nguyen T, Shen C H, Sharp P A, Eisen H N and Chen, J. (Proc Natl Acad Sci USA 2003 Mar. 4; 100(5):2718-23, RNA interference of influenza virus production by directly targeting mRNA for degradation and indirectly inhibiting all viral RNA transcription) disclose that Influenza A virus causes widespread infection in the human respiratory tract, but existing vaccines and drug therapy are of limited value. Here we show that short interfering RNAs (siRNAs) specific for conserved regions of the viral genome can potently inhibit influenza virus production in both cell lines and embryonated chicken eggs. The inhibition depends on the presence of a functional antisense strand in the siRNA duplex, suggesting that viral mRNA is the target of RNA interference. However, siRNA specific for nucleocapsid (NP) or a component of the RNA transcriptase (PA) abolished the accumulation of not only the corresponding mRNA but also virion RNA and its complementary RNA. These siRNAs also broadly inhibited the accumulation of other viral, but not cellular, RNAs. The findings reveal that newly synthesized NP and PA proteins are required for influenza virus transcription and replication and provide a basis for the development of siRNAs as prophylaxis and therapy for influenza infection in humans.

The present application shows the disruption of KLF6. Yoon H S, Chen X and Yang V W (J Biol Chem 2003 Jan. 24; 278(4):2101-5, Kruppel-like factor 4 mediates p53-dependent G1/S cell cycle arrest in response to DNA damage) show siRNA effectiveness on a related protein KLF4. The tumor suppressor p53 is required for the maintenance of genomic integrity following DNA damage. One mechanism by which p53 functions is to induce a block in the transition between the G(1) and S phase of the cell cycle. Previous studies indicate that the Kruppel-like factor 4 (KLF4) gene is activated following DNA damage and that such activation depends on p53. In addition, enforced expression of KLF4 causes G(1)/S arrest. The present study examines the requirement of KLF4 in mediating the p53-dependent cell cycle arrest process in response to DNA damage. We show that the G(1) population of a colon cancer cell line, HCT116, that is null for the p53 alleles (−/−) was abolished following gamma irradiation compared with cells with wild-type p53 (+/+). Conditional expression of KL4 in irradiated HCT116 p53−/− cells restored the G(1) cell population to a level similar to that seen in irradiated HCT116 p53+/+ cells. Conversely, treatment of HCT116 p53+/+ cells with small interfering RNA (siRNA) specific for KLF4 significantly reduced the number of cells in the G(1) phase following gamma irradiation compared with the untreated control or those treated with a nonspecific siRNA. In each case the increase or decrease in KLT4 level because of conditional induction or siRNA inhibition, respectively, was accompanied by an increase or decrease in the level of p21(WAF1/CIP1). Results of our study indicate that KLF4 is an essential mediator of p53 in controlling G(1)/S progression of the cell cycle following DNA damage.

Once the genes are known, the present approach can be used to protect humans (and other animals from disease (Olson K E, Adelman Z N, Travanty E A, Sanchez-Vargas I, Beaty B J and Blair C D, Developing arbovirus resistance in mosquitoes, Insect Biochem Mol Biol 2002 October; 32(10): 1333-43). Diseases caused by arthropod-borne viruses are increasingly significant public health problems, and novel methods are needed to control pathogen transmission The hypothesis underlying the research described here is that genetic manipulation of *Aedes aegypti* mosquitoes can profoundly and permanently reduce their competence to transmit dengue viruses to human hosts. Recent key findings now allow us to test the genetic control hypothesis. We have identified viral genome-derived RNA segments that can be expressed in mosquito midgets and salivary glands to ablate homologous virus replication and transmission. We have demonstrated that both transient and heritable expression of virus-derived effector RNAs in cultured mosquito cells can silence virus replication, and have characterized the mechanism of RNA-mediated resistance. We are now developing virus-resistant mosquito lines by transformation with transposable elements that express effector RNAs from mosquito-active promoters.

The targeting of IGF2 (one of the genes disrupted in the present method) has produced good results in cancer of the liver (Yao X, Hu J F, Daniels M, Shiran H, Zhou X, Yan H, Lu H, Zeng Z, Wang Q, Li T, Hoffman A R, A methylated oligonucleotide inhibits IGF2 expression and enhances survival in a model of hepatocellular carcinoma, J Clin Invest 2003 January; 111(2):265-73). IGF2 is a mitogenic peptide that has been implicated in hepatocellular oncogenesis. Since the silencing of gene expression is frequently associated with cytosine methylation at cytosine-guanine (CpG) dinucleotides, we designed a methylated oligonucleotide (MON1) complementary to a region encompassing IGF2 promoter P4 in an attempt to induce DNA methylation at that locus and diminish IGF2 mRNA levels. MON1 specifically inhibited IGF2 mRNA accumulation in vitro, whereas an oligonucleotide (ON1) with the same sequence but with nonmethylated cytosines had no effect on IGF2 mRNA abundance. MON1 treatment led to the specific induction of de novo DNA methylation in the region of IGF2 promoter hP4. Cells from a human hepatocellular carcinoma (HCC) cell line, Hep 3B, were implanted into the livers of nude mice, resulting in the growth of large tumors. Animals treated with MON1 had markedly prolonged survival as compared with those animals treated with saline or a truncated methylated oligonucleotide that did not alter IGF2 mRNA levels in vitro. This study demonstrates that a methylated sense oligonucleotide can be used to induce epigenetic changes in the IGF2 gene and that inhibition of IGF2 mRNA accumulation may lead to enhanced survival in a model of HCC.

The present methods provide a method of screening a compound for treating a viral infection, comprising administering the compound to a cell containing a cellular gene functionally encoding a gene product necessary for reproduction of the virus in the cell but not necessary for survival of the cell and detecting level of the gene product produced, a decrease or elimination of the gene product indicating a compound for treating the viral infection. The present methods also provide a method of screening a compound for effectiveness in treating a viral infection, comprising administering the compound to a cell containing a cellular gene functionally encoding a gene product necessary for reproduction of the virus in the cell but not necessary for survival of the cell and detecting the level of the gene product produced, a decrease or elimination of the gene product indicating a compound effective for treating the viral infection. The cellular gene can be, for example, any gene provided herein, i.e., any of the genes comprising the nucleotide sequences set forth in any of the sequences in SEQ ID LIST 1 or any other gene obtained using the methods provided herein for obtaining such genes. Level of the gene product can be measured by any standard means, such as by detection with an antibody specific for the protein. The level of gene product can be compared to the level of the gene product in a control cell not contacted with the compound. The level of gene product can be compared to the level of the gene product in the same cell prior to addition of the compound. Activity of function, can be measured by any standard means, such as by enzymatic assays that measure the conversion of a substrate to a product or binding assays that measure the binding of a protein to a nucleic acids, for example. Relatedly, the regulatory region of the gene can be functionally linked to a reporter gene and compounds can be screened for inhibition of the reporter gene. Such reporter constructs are described herein.

Examples of gene products whose activity/function can be measured and which are disclosed herein include, but are not limited to tristetraprolin (human ZFP-36), 6-pyruvoyl-tetrahydropterin synthase, a eukaryotic DnaJ-like protein, ID3 (inhibitor of DNA binding 3), N-acetylglucos-aminyltransferase I (mGAT-1), cleavage stimulation factor (CSTF2), TAK1 binding protein, human zinc transcription factor ZPF207, Dlx2, Smad7 (Mad-related protein), and P-glycoprotein (mdr1b). The activity can be compared to the activity in a control cell not contacted with the compound or in the same cell prior to addition of the compound.

The present invention also provides a method of screening a compound for effectiveness in treating or preventing a viral infection comprising contacting the compound with the gene product of a cellular gene comprising a nucleic acid of SEQ ID LIST 1, or any homolog thereof, or a gene identified in Table 1 or 2 or otherwise in this application, and detecting the function of the gene product, a decrease or elimination of the function indicating a compound effective for treating or preventing viral infection. Examples of gene products that can be utilized in these methods include, but are not limited to tristetraprolin (human ZFP-36), 6-pyruvoyl-tetrahydropterin synthase, a eukaryotic DnaJ-like protein, ID3 (inhibitor of DNA binding 3), N-acetylglucos-aminyltransferase I (mGAT-1), cleavage stimulation factor (CSTF2), TAK1 binding protein, CTCF, human zinc transcription factor ZPF207, Dlx2, Smad7 (Mad-related protein), and P-glycoprotein (mdr1b). The activity can be compared to the activity in a control cell not contacted with the compound or in the same cell prior to addition of the compound.

The present invention provides a method of selectively eliminating cells persistently infected with a virus from an animal cell culture capable of surviving for a first period of time in the absence of serum, comprising propagating the cell culture in the absence of serum for a second time period which a persistently infected cell cannot survive without serum, thereby selectively eliminating from the cell culture cells persistently infected with the virus. The second time period should be shorter than the first time period. Thus one can simply eliminate serum from a standard culture medium composition for a period of time (e.g. by removing serum containing medium from the culture container, rinsing the cells, and adding serum-free medium back to the container), then, after a time of serum starvation, return serum to the culture medium. Alternatively, one can inhibit a serum survival factor from the culture in place of the step of serum starvation. Furthermore, one can instead interfere with the virus-factor interaction. Such a viral elimination method can periodically be performed for cultured cells to ensure that they remain virus-free. The time period of serum removal can greatly vary, with a typical range being about 1 to about 30 days; a preferable period can be about 3 to about 10 days, and a more preferable period can be about 5 days to about 7 days. This time period can be selected based upon ability of the specific cell to survive without serum as well as the life cycle of the virus, e.g., for reovirus, which has a life cycle of about 24 hours, 3 days' starvation of cells provides dramatic results.

Furthermore, the time period can be shortened by also passaging the cells during the starvation; in general, increasing the number of passages can decrease the time of serum starvation (or serum factor inhibition) needed to get full clearance of the virus from the culture. While passaging, the cells typically are exposed briefly to serum (typically for about 3 to about 24 hours). This exposure both stops the action of the trypsin used to dislodge the cells and stimulates the cells into another cycle of growth, thus aiding in this selection process. Thus a starvation/serum cycle can be repeated to optimize the selective effect. Other standard culture parameters, such as confluency of the cultures, pH, temperature, etc. can be varied to alter the needed time period of serum starvation (or serum survival factor inhibition). This time period can readily be determined for any given viral infection by simply removing the serum for various periods of time, then testing the cultures for the presence of the infected cells (e.g., by ability to survive in the absence of serum and confirmed by quantitating virus in cells by standard virus titration and immunohistochemical techniques) at each tested time period, and then detecting at which time periods of serum deprivation the virally infected cells were eliminated. It is preferable that shorter time periods of serum deprivation that still provide elimination of the persistently infected cells be used. Furthermore, the cycle of starvation, then adding back serum and determining amount of virus remaining in the culture can be repeated until no virtually infected cells remain in the culture.

Thus, the present method can further comprise passaging the cells, i.e., transferring the cell culture from a first container to a second container. Such transfer can facilitate the selective lack of survival of virally infected cells. Transfer can be repeated several times. Transfer is achieved by standard methods of tissue culture (see, e.g., Freshney, *Culture of Animal Cells, A Manual of Basic Technique,* 2nd Ed. Alan R. Liss, Inc., New York, 1987).

The present method further provides a method of selectively eliminating from a cell culture cells persistently infected with a virus, comprising propagating the cell culture in the absence of a functional form of the serum protein having a molecular weight of between about 50 kD and 100 kD which resists inactivation in low pH and resists inactivation by chloroform extraction, which inactivates when boiled and inactivates in low ionic strength solution, and which when removed from a cell culture comprising cells persistently infected with reovirus substantially prevents survival of cells persistently infected with reovirus. The absence of the functional form can be achieved by any of several standard means, such as by binding the protein to an antibody selective for it (binding the antibody in serum either before or after the serum is added to the cells; if before, the serum protein can be removed from the serum by, e.g., binding the antibody to a column and passing the serum over the column and then administering the survival protein-free serum to the cells), by administering a compound that inactivates the protein, or by administering a compound that interferes with the interaction between the virus and the protein.

Thus, the present invention provides a method of selectively eliminating from a cell culture propagated in serum-containing medium cells persistently infected with a virus, comprising inhibiting in the serum the protein having a molecular weight of between about 50 kD and 100 d) which resists inactivation in low pH and resists inactivation by chloroform extraction, which inactivates when boiled and inactivates in low ionic strength solution, and which when removed from a cell culture comprising cells persistently infected with reovirus substantially prevents survival of cells persistently infected with reovirus. Alternatively, the interaction between the virus and the serum protein can be disrupted to selectively eliminate cells persistently infected with the virus.

Any virus capable of some form of persistent infection may be eliminated from a cell culture utilizing the present elimination methods, including removing, inhibiting or otherwise interfering with a serum protein, such as the one exemplified herein, and also including removing, inhibiting or otherwise interfering with a gene product from any cellular gene found by the present method to be necessary for viral growth yet nonessential to the cell. For example, DNA viruses or RNA viruses can be targeted. One can readily determine whether cells infected with a selected virus can be selectively removed from a culture through removal of serum by starving cells permissive to the virus of serum (or inhibiting the serum survival factor), adding the selected virus to the cells, adding serum to the culture, and observing whether infected cells die (i.e., by titering levels of virus in the surviving cells with an antibody specific for the virus).

A culture of any animal cell (i.e., any cell that is typically grown and maintained in culture in serum) that can be maintained for a period of time in the absence of serum, can be purified from viral infection utilizing the present method. For example, primary cultures as well as established cultures and cell lines can be used. Furthermore, cultures of cells from any animal and any tissue or cell type within that animal that can be cultured and that can be maintained for a period of time in the absence of serum can be used. For example, cultures of cells from tissues typically infected, and particularly persistently infected, by an infectious virus could be used.

As used in the claims "in the absence of serum" means at a level at which persistently virally infected cells do not survive. Typically, the threshold level is about 1% serum in the media. Therefore, about 1% serum or less can be used, such as about 1%, 0.75%, 0.50%. 0.25% 0.1% or no serum can be used.

As used herein, "selectively eliminating" cells persistently infected with a virus means that substantially all of the cells persistently infected with the virus are killed such that the presence of virally infected cells cannot be detected in the culture immediately after the elimination procedure has been performed. Furthermore, "selectively eliminating" includes that cells not infected with the virus are generally not killed by the method. Some surviving cells may still produce virus but at a lower level, and some may be defective in pathways that lead to death by the virus. Typically, for cells persistently infected with virus to be substantially all killed, more than about 90% of the cells, and more preferably less than about 95%, 98%, 99%, or 99.99% of virus-containing cells in the culture are killed.

The present method also provides a nucleic acid comprising the regulatory region of any of the genes. Such regulatory regions can be isolated from the genomic sequences isolated and sequenced as described above and identified by any characteristics observed that are characteristic for regulatory regions of the species and by their relation to the start codon for the coding region of the gene. The present invention also provides a construct comprising the regulatory region functionally linked to a reporter gene. Such constructs are made by routine subcloning methods, and many vectors are available into which regulatory regions can be subcloned upstream of a marker gene. Marker genes can be chosen for ease of detection of marker gene product.

The present method therefore also provides a method of screening a compound for treating a viral infection, comprising administering the compound to a cell containing any of the above-described constructs, comprising a regulatory region of one of the genes comprising the nucleotide sequence set forth in any of the sequences in SEQ ID LIST 1 functionally linked to a reporter gene, and detecting the level of the reporter gene product produced, a decrease or elimination of the reporter gene product indicating a compound for treating the viral infection. Compounds detected by this method would inhibit transcription of the gene from which the regulatory region was isolated, and thus, in treating a subject, would inhibit the production of the gene product produced by the gene, and thus treat the viral infection.

Some genes when disrupted by the present method of retrovirus insertion, resulted in overexpression of the gene product, and this overexpression inhibited viral replication. Specifically, as described in the Examples, by utilizing the methods of the present invention, the genomic locus comprising the sequence of CTCF was disrupted (clone designated 6BE72_rE (SEQ ID NO: 2) and this resulted in an overexpression of IGF2 which led to decreased viral replication. Therefore, the present invention provides a method of decreasing or inhibiting viral replication by overexpressing IGF2. The present invention also provides a method of increasing the expression of IGF2 by disrupting the CTCF gene, or by inhibiting the gene product of the CTCF gene. The human genomic sequence for IGF2 can be found on the publicly available GenBank Database under Accession No. NT_033238. This sequence, available via GenBank Accession No. NT_03328 is hereby incorporated by reference in its entirety by this reference. The human mRNA sequence for IGF2 can also be found on GenBank under Accession No. NM_00612. This sequence, available via GenBank Accession No. NM_00612 is hereby incorporated by reference in its entirety by this reference. The human mRNA sequence for CTCF can be found on GenBank under Accession No. NM_080618. This sequence, available via GenBank Accession No. NM_00612 is hereby incorporated by reference in its entirety by this reference. The human genomic sequence for CTCF, located on human chromosomal location 16q21-q22.3, can be found on GenBank under Accession No. NT_10478. This sequence available via GenBank Accession No. NT_010478 is hereby incorporated by reference in its entirety.

In another example, the methods of the present invention identified another clone (Lab Designation 14_7#2 SEQ ID NO: 115)) which results in overexpression of N-acetylglucosaminyltransferase I which is encoded by Mgat-1. Overexpression of N-acetylglucosaminyltransfease I resulted in decreased viral replication.

Once a gene is found that upon disruption results in overexpression of another gene, the gene that is overexpressed can be modulated directly, i.e., via the overexpressed gene, or indirectly, i.e., via the gene that was originally disrupted (or its gene product) or via another gene (or its gene product) associated with the overexpressed gene. For example, one of skill in the art can administer a compound that results in the overexpression of IGF2. This compound may interact with the IGF2 gene, IGP2 mRNA or the IGF2 protein. The compound could also interact with the CTCF gene, CTCF mRNA or the CTCF protein to increase IGF2 expression. The compound can also interact with other genes, mRNAs or proteins involved in the IGF2 pathway, resulting in, increased IGF2 expression.

Thus, the present invention provides a method of screening a compound for effectiveness in treating a viral infection, comprising administering the compound to a cell containing a cellular gene functionally encoding a gene product whose overexpression inhibits reproduction of the virus, but does not prevent survival of the cell and detecting the level of the gene product produced, an increase in the gene product indicating a compound effective for treating a viral infection. Typically, an increase will be 10%, 20%, 30%, 40%, 50%, 60%, 70%, 80%, 90%, 100%, 125%, 150%, 175%, 200%, 300%, 400%, 500% or higher increase over gene product produced when the compound is not present.

The present invention additionally provides a method of reducing or inhibiting a viral infection in a subject, comprising administering to the subject an amount of a composition that inhibits expression or functioning of a gene product encoded by a gene comprising the nucleic acid set forth in any of the sequences in the Sequence Listing or a homolog thereof, or a gene identified in Table 1 or 2, or otherwise, in this application, thereby treating the viral infection. The composition can comprise, for example, an antibody that binds a protein encoded by the gene. The composition can also comprise an antibody that binds a receptor for a protein encoded by the gene. Such an antibody can be raised against the selected protein by standard methods, and can be either polyclonal or monoclonal, though monoclonal is preferred. Alternatively, the composition can comprise an antisense RNA that binds an RNA encoded by the gene. Furthermore, the composition can comprise a nucleic acid functionally encoding an antisense RNA that binds an RNA encoded by the gene. Other useful compositions will be readily apparent to the skilled artisan.

The present invention also provides a method of treating a viral infection in a subject comprising administering to the subject a treatment effective amount of a composition that increases expression of a gene whose overexpression reduces or inhibits viral replication. Typically, an increase in expression will be a 10%, 20%, 30%, 40%, 50%, 60%, 70%, 80%, 90%, 100%, 125%, 150%, 175%, 200%, 300%, 400%, 500% or higher increase over gene product produced when the composition is not present.

The present invention further provides a method of reducing or inhibiting a viral infection in a subject comprising mutating ex vivo in a selected cell from the subject an endogenous gene comprising the nucleic acid set forth in any of the sequences listed in SEQ ID LIST 1, or a homolog thereof, to a gene form incapable of producing a functional gene product of the gene or a gene form producing a reduced amount of a functional gene product of the gene, and replacing the cell in the subject, thereby reducing viral infection of cells in the subject. The cell can be selected according to the typical target cell of the specific virus whose infection is to be reduced, prevented or inhibited. A preferred cell for several viruses is a hematopoietic cell. When the selected cell is a hematopoietic cell, viruses which can be reduced or inhibited from infection can include, for example, HIV, including HIV-1 and HIV-2.

The invention also includes a method of reducing or inhibiting viral infection in a subject comprising mutating ex vivo in a selected cell, for example from a subject or an allogenic source, an endogenous gene comprising a nucleic acid set forth in SEQ ID LIST 1 whose overexpression causes inhibition of viral replication, or a homolog thereof, to a gene form that expresses the gene at a higher level than the endogenous gene, and placing or replacing the cell in the subject. Typically, a higher level can be 10%, 20%, 30%, 40%, 50%, 60%, 70%, 80%, 90%, 100%, 125%, 150%, 175%, 200%, 300%, 400%, 500% or higher than the non-mutated, endogenous gene. The cell can be selected according to the typical target cell of the specific virus whose infection is to be reduced, prevented or inhibited. A preferred cell for several viruses is a hematopoietic cell. When the selected cell is a hematopoietic cell, viruses which can be reduced or inhibited from infection can include, for example, HIV, including HIV-1 and HIV-2. However, many other virus-cell combinations will be apparent to the skilled artisan.

The present invention additionally provides a method of increasing viral infection resistance in a subject comprising mutating ex vivo in a selected cell, for example from the subject or from an allogenic source, an endogenous gene comprising a nucleic acid set forth in SEQ LIST 1, whose inhibition or reduction in expression increases viral infection resistance, said endogenous gene being mutated to a mutated gene form incapable of producing a functional gene product of the gene or a gene form producing a reduced amount of a functional gene product of the gene, and placing the cell in the subject, thereby increasing viral infection resistance of cells in the subject. The virus can be HIV, particularly when the cell is a hematopoietic cell. However, many other virus-cell combinations will be apparent to the skilled artisan.

The present invention also provides a method of reducing or inhibiting a viral infection in a subject comprising mutating ex vivo in a selected cell from the subject an endogenous gene comprising a nucleic acid isolated by a method comprising (a) transferring into a cell culture growing in serum-containing medium a vector encoding a selective marker gene lacking a functional promoter, (b) selecting cells expressing the marker gene, (c) removing serum from the culture medium, (d) infecting the cell culture with the virus, and (e) isolating from the surviving cells a cellular gene within which the marker gene is inserted, to a mutated gene form incapable of producing a functional gene product of the gene or to a mutated gene form producing a reduced amount of a functional gene product of the gene, and replacing the cell in the subject, thereby reducing viral infection of cells in the subject. Thus the mutated gene form can be one incapable of producing an effective amount of a functional protein or mRNA, or one incapable of producing a functional protein or mRNA, for example. The method can be performed wherein the virus is HIV. The method can be performed in any selected cell in which the virus may infect with deleterious results. For example, the cell can be a hematopoietic cell. However, many other virus-cell combinations will be apparent to the skilled artisan.

The present invention additionally provides a method of increasing viral infection resistance in a subject comprising mutating ex vivo in a selected cell from the subject an endogenous gene comprising a nucleic acid isolated by a method comprising (a) transferring into a cell culture growing in serum-containing medium a vector encoding a selective marker gene lacking a functional promoter, (b) selecting cells expressing the marker gene, (c) removing serum from the culture medium, (d) infecting the cell culture with the virus, and (e) isolating from the surviving cells a cellular gene within which the marker gene is inserted, to a mutated gene form incapable of producing a functional gene product of the gene or a gene form producing a reduced amount of a functional gene product of the gene, and replacing the cell in the subject, thereby reducing viral infection of cells in the subject. The virus can be HIV, particularly when the cell is a hematopoietic cell. However, many other virus-cell combinations will be apparent to the skilled artisan.

The present invention also provides a method of reducing or inhibiting a viral infection in a subject comprising mutating ex vivo in a selected cell from the subject an endogenous gene comprising a nucleic acid isolated by a method comprising (a) transferring into a cell culture growing in serum-containing medium a vector encoding a selective marker gene lacking a functional promoter, (b) selecting cells expressing the marker gene, (c) infecting the cell culture with the virus, and (d) isolating from the surviving cells a cellular gene within which the marker gene is inserted, to a mutated gene form incapable of producing a functional gene product of the gene or to a mutated gene form producing a reduced amount of a functional gene product of the gene, and replacing the cell in the subject, thereby reducing viral infection of cells in the subject. Thus the mutated gene form can be one incapable of producing an effective amount of a functional protein or mRNA, or one incapable of producing a functional protein or mRNA, for example. The method can be performed wherein the virus is HIV. The method can be performed in any selected cell in which the virus may infect with deleterious results. For example, the cell can be a hematopoietic cell. However, many other virus-cell combinations will be apparent to the skilled artisan.

The present invention additionally provides a method of increasing viral infection resistance in a subject comprising mutating ex vivo in a selected cell from the subject an endogenous gene comprising a nucleic acid isolated by a method comprising (a) transferring into a cell culture growing in serum-containing medium a vector encoding a selective marker gene lacking a functional promoter, (b) selecting cells expressing the marker gene, (c) infecting the cell culture with the virus, and (d) isolating from the surviving cells a cellular gene within which the marker gene is inserted, to a mutated gene form incapable of producing a functional gene product of the gene or a gene form producing a reduced amount of a functional gene product of the gene, and replacing the cell in the subject, thereby reducing viral infection of cells in the subject. The virus can be HIV, particularly when the cell is a hematopoietic cell. However, many other virus-cell combinations will be apparent to the skilled artisan.

Furthermore, the present invention provides a method for isolation of cellular genes utilized in tumor progression. The present invention provides a method of identifying a cellular gene that can suppress a malignant phenotype in a cell, comprising (a) transferring into a cell culture incapable of growing well in soft agar or Matrigel a vector encoding a selective marker gene lacking a functional promoter, (b) selecting cells expressing the marker gene, and (c) isolating from selected cells which are capable of growing in soft agar or Matrigel a cellular gene within which the marker gene is inserted, thereby identifying a gene that can suppress a malignant phenotype in a cell. This method can be performed using any selected non-transformed cell line, of which many are known in the art.

The present invention additionally provides a method of identifying a cellular gene that can suppress a malignant phenotype in a cell, comprising (a) transferring into a cell culture of non-transformed cells a vector encoding a selective marker gene lacking a functional promoter, (b) selecting cells expressing the marker gene, and (c) isolating from selected and transformed cells a cellular gene within which the marker gene is inserted, thereby identifying a gene that can suppress a malignant phenotype in a cell. A non-transformed phenotype can be determined by any of several standard methods in the art, such as the exemplified inability to grow in soft agar, or inability to grow in Matrigel.

The present invention additionally provides a method of identifying a cellular gene that can suppress a malignant phenotype in a cell, comprising (a) transferring into a cell culture of non-transformed cells a vector encoding a selective marker gene lacking a functional promoter, (b) selecting cells expressing the marker gene, and (c) isolating from selected and transformed cells a cellular gene within which the marker gene is inserted, thereby identifying a gene that can suppress a malignant phenotype in a cell. A non-transformed phenotype can be determined by any of several standard methods in the art, such as the exemplified inability to grow in soft agar, or inability to grow in Matrigel. This method can be performed using any selected non-transformed cell line, of which many are known in the art.

The present invention further provides a method of screening for a compound for suppressing a malignant phenotype in a cell comprising administering the compound to a cell containing a cellular gene functionally encoding a gene product involved in establishment of a malignant phenotype in the cell and detecting the level of the gene product produced, a decrease or elimination of the gene product indicating a compound effective for suppressing the malignant phenotype. Detection of the level, or amount, of gene product produced can be measured, directly or indirectly, by any of several methods standard in the art (e.g., protein gel, antibody-based assay, detecting labeled RNA) for assaying protein levels or amounts, and selected based upon the specific gene product.

The present invention further provides a method of suppressing a malignant phenotype in a cell in a subject, comprising administering to the subject an amount of a composition that inhibits expression or functioning of a gene product encoded by a gene comprising the nucleic acid set forth in SEQ ID NO:76, SEQ ID NO:77, SEQ ID NO:78, SEQ ID NO:79, SEQ ID NO:80, SEQ ID NO:81, SEQ ID NO:82 or SEQ ID NO:83, SEQ ID NO: 92, SEQ ID NO: 109, SEQ ID NO: 110, SEQ ID NO: 111, SEQ ID NO: 112, SEQ ID NO: 119, SEQ ID NO: 177, SEQ ID NO: 206, SEQ ID NO: 240, SEQ ID NO: 243, SEQ ID NO: 247, SEQ ID NO: 321, SEQ ID NO: 328, SEQ ID NO: 329, SEQ ID NO: 330, SEQ ID NO: 331, SEQ ID NO: 334, SEQ ID NO: 335, SEQ ID NO: 336, SEQ ID NO: 408, SEQ ID NO: 411, SEQ ID NO: 412, SEQ ID NO: 413, SEQ ID NO: 414 or a homolog thereof, or any gene whose overexpression is found by the present method to be involved in suppressing a malignant phenotype in the cell (e.g., any clone designated herein with an "x" throughout the application) thereby suppressing a malignant phenotype. The composition can, for example, comprise an antibody that binds a protein encoded by the gene. The composition can, as another example, comprise an antibody that binds a receptor for a protein encoded by the gene. The composition can comprise an antisense RNA that binds an RNA encoded by the gene. Further, the composition can comprise a nucleic acid functionally encoding an antisense RNA that binds an RNA encoded by the gene.

The present invention further provides a method of suppressing a malignant phenotype in a cell in a subject, comprising administering to the subject an amount of a composition that increases expression of a gene product whose overexpression is involved in suppressing a malignant phenotype in the cell. The gene product can be the product of a gene wherein disruption of an upstream gene by the present vector resulted in overexpression of the downstream gene, and the overexpression of the downstream gene demonstrated a transformed phenotype. The composition can be, for example, an inhibitor, such as a small molecule inhibitor, of the COX 2 enzyme.

Diagnostic or therapeutic agents of the present invention can be administered to a subject or an animal model by any of many standard means for administering therapeutics or diagnostics to that selected site or standard for administering that type of functional entity. For example, an agent can be administered orally, parenterally (e.g., intravenously), by intramuscular injection, by intraperitoneal injection, topically, transdermally, or the like. Agents can be administered, e.g., as a complex with cationic liposomes, or encapsulated in anionic liposomes. Compositions can include various amounts of the selected agent in combination with a pharmaceutically acceptable carrier and, in addition, if desired, may include other medicinal agents, pharmaceutical agents, carriers, adjuvants, diluents, etc. Parental administration, if used, is generally characterized by injection. Injectables can be prepared in conventional forms, either as liquid solutions or suspensions, solid forms suitable for solution or suspension in liquid prior to injection, or as emulsions. Depending upon the mode of administration, the agent can be optimized to avoid degradation in the subject, such as by encapsulation, etc.

Dosages will depend upon the mode of administration, the disease or condition to be treated, and the individual subject's condition, but will be that dosage typical for and used in administration of antiviral or anticancer agents. Dosages will also depend upon the composition being administered, e.g., a protein or a nucleic acid. Such dosages are known in the art. Furthermore, the dosage can be adjusted according to the typical dosage for the specific disease or condition to be treated. Furthermore, viral titers in culture cells of the target cell type can be used to optimize the dosage for the target cells in vivo, and transformation from varying dosages achieved in culture cells of the same type as the target cell type can be monitored. Often a single dose can be sufficient; however, the dose can be repeated if desirable. The dosage should not be so large as to cause adverse side effects. Generally, the dosage will vary with the age, condition, sex and extent of the disease in the patient and can be determined by one of skill in the art. The dosage can also be adjusted by the individual physician in the event of any complication.

For administration to a cell in a subject, the composition, once in the subject, will of course adjust to the subject's body temperature. For ex vivo administration, the composition can be administered by any standard methods that would maintain viability of the cells, such as by adding it to culture medium (appropriate for the target cells) and adding this medium directly to the cells. As is known in the art, any medium used in this method can be aqueous and non-toxic so as not to render the cells non-viable. In addition, it can contain standard nutrients for maintaining viability of cells, if desired. For in vivo administration, the complex can be added to, for example, a blood sample or a tissue sample from the patient, or to a pharmaceutically acceptable carrier, e.g., saline and buffered saline, and administered by any of several means known in the art. Examples of administration include parenteral administration, e.g., by intravenous injection including regional perfusion through a blood vessel supplying the tissues(s) or organ(s) having the target cell(s), or by inhalation of an aerosol, subcutaneous or intramuscular injection, topical administration such as to skin wounds and lesions, direct transfection into, e.g., bone marrow cells prepared for transplantation and subsequent transplantation into the subject, and direct transfection into an organ that is subsequently transplanted into the subject. Further administration methods include oral administration, particularly when the composition is encapsulated, or rectal administration, particularly when the composition is in suppository form. A pharmaceutically acceptable carrier includes any material that is not biologically or otherwise undesirable, i.e., the material may be administered to an individual along with the selected complex without causing any undesirable biological effects or interacting in a deleterious manner with any of the other components of the pharmaceutical composition in which it is contained.

Specifically, if a particular cell type in vivo is to be targeted, for example, by regional perfusion of an organ or tumor, cells from the target tissue can be biopsied and optimal dosages for import of the complex into that tissue can be determined in vitro, as described herein and as known in the art, to optimize the in vivo dosage, including concentration and time length. Alternatively, culture cells of the same cell type can also be used to optimize the dosage for the target cells in vivo.

For either ex vivo or in vivo use, the complex can be administered at any effective concentration. An effective concentration is that amount that results in reduction, inhibition or prevention of the viral infection or in reduction or inhibition of transformed phenotype of the cells A nucleic acid can be administered in any of several means, which can be selected according to the vector utilized, the organ or tissue, if any, to be targeted, and the characteristics of the subject. The nucleic acids, if desired in a pharmaceutically acceptable carrier such as physiological saline, can be administered systemically, such as intravenously, intraarterially, orally, parenterally, subcutaneously. The nucleic acids can also be administered by direct injection into an organ or by injection into the blood vessel supplying a target tissue. For an infection of cells of the lungs or trachea, it can be administered intratracheally. The nucleic acids can additionally be administered topically, transdermally, etc.

The nucleic acid or protein can be administered in a composition. For example, the composition can comprise other medicinal agents, pharmaceutical agents, carriers, adjuvants, diluents, etc. Furthermore, the composition can comprise, in addition to the vector, lipids such as liposomes, such as cationic liposomes (e.g., DOTMA, DOPE, DC-cholesterol) or anionic liposomes. Liposomes can further comprise proteins to facilitate targeting a particular cell, if desired. Administration of a composition comprising a vector and a cationic liposome can be administered to the blood afferent to a target organ or inhaled into the respiratory tract to target cells of the respiratory tract. Regarding liposomes, see, e.g., Brigham et al. *Am. J. Resp. Cell. Mol. Biol.* 1:95-100 (1989); Felgner et al. *Proc. Natl. Acad. Sci. USA* 84:7413-7417 (1987); U.S. Pat. No. 4,897,355.

For a viral vector comprising a nucleic acid, the composition can comprise a pharmaceutically acceptable carrier such as phosphate buffered saline or saline. The viral vector can be selected according to the target cell, as known in the art. For example, adenoviral vectors, in particular replication-deficient adenoviral vectors, can be utilized to target any of a number of cells, because of its broad host range. Many other viral vectors are available, and their target cells known.

EXAMPLES

Selective Elimination of Virally Infected Cells from a Cell Culture

Rat intestinal cell line-1 cells (RIE-1 cells) were standardly grown in Dulbecco's modified eagle's medium, high glucose, supplemented with 10% fetal bovine serum. To begin the experiment, cells persistently infected with reovirus were grown to near confluence, then serum was removed from the growth medium by removing the medium, washing the cells in PBS, and returning to the flask medium not supplemented with serum. Typically, the serum content was reduced to 1% or less. The cells are starved for serum for several days, or as long as about a month, to bring them to quiescence or growth arrest. Media containing 10% serum is then added to the quiescent cells to stimulate growth of the cells. Surviving cells are found to not to be persistently infected cells by immunohistochemical techniques used to establish whether cells contain any infectious virus,(sensitivity to 1 infectious virus per ml of homogenized cells).

Cellular Genomic DNA Isolation

Gene Trap Libraries: The libraries are generated by infecting the RIE-1 cells with a retrovirus vector (U3 gene-trap) at a ratio of less than one retrovirus for every ten cells. When a U3 gene trap retrovirus integrates within an actively transcribed gene, the neomycin resistance gene that the U3 gene trap retrovirus encodes is also transcribed, this confers resistance to the cell to the antibiotic neomycin. Cells with gene trap events are able to survive exposure to neomycin while cells without a gene trap event die. The various cells that survive neomycin selection are then propagated as a library of gene trap events. Such libraries can be generated with any retrovirus vector that has the properties of expressing a reporter gene from a transcriptionally active cellular promoter that tags the gene for later identification.

Reovirus selection: Reovirus infection is typically lethal to RIE-1 cells but can result in the development of persistently infected cells. These cells continue to grow while producing infective reovirus particles. For the identification of gene trap events that confer reovirus resistance to cells, the persistently infected cells must be eliminated or they will be scored as false positives. We have found that RIE-1 cells persistently infected with reovirus are very poorly tolerant to serum starvation, passaging and plating at low density. Thus, we have developed protocols for the screening of the RIE-1 gene trap libraries that select against both reovirus sensitive cells and cells that are persistently infected with reovirus.

1. RIE-1 library cells are grown to near confluence and then the serum is removed from the media. The cells are starved for serum for several days to bring them to quiescent or growth arrest.
2. The library cells are infected with reovirus at a titer of greater than ten reovirus per cell and the serum starvation is continued for several more days.
3. The infected cells are passaged, (a process in which they are exposed to serum for three to six hours) and then starved for serum for several more days.
4. The surviving cells are then allowed to grow in the presence of serum until visible colonies develop at which point they are cloned by limiting dilution.

MEDIA: DULBECCO'S MODIFIED EAGLE'S MEDIUM, HIGH GLUCOSE (DME/HIGH) Hyclone Laboratories cat. no. SH30003.02.

NEOMYCIN: The antibiotic used to select against the cells that did not have a U3 gene trap retrovirus. We used GENETICIN, from Sigma. cat. no. G9516.

RAT INTESTINAL CELL LINE-1 CELLS (RIE-1 CELLS): These cells are from the laboratory of Dr. Ray Dubois (VAMC). They are typically cultured in Dulbecco's Modified Eagle's Medium supplemented with 10% fetal calf serum.

REOVIRUS: Laboratory strains of either serotype 1 or serotype 3 are used. They were originally obtained from the laboratories of Bernard N. Fields (deceased). These viruses have been described in detail.

RETROVIRUS: The U3 gene trap retrovirus used here were developed by Dr. Earl Ruley (VAMC) and the libraries were produced using a general protocol suggested by him.

SERUM: FETAL BOVINE SERUM Hyclone Laboratories cat. no. A-1115-L.

Genes Necessary for Viral Infection

Characteristics of some of the isolated sequences include the following:

SEQ ID NO:1—rat genomic sequence of vacuolar H+ ATPase (chemically inhibiting the activity of the gene product results in resistance to influenza virus and reovirus)

SEQ ID NO:2—rat alpha tropomyosin genomic sequence

SEQ ID NO:3—rat genomic sequence of murine and rat gas5 gene (cell cycle regulated gene)

SEQ ID NO:4—rat genomic sequence of p162 of ras complex, mouse, human (cell cycle regulated gene)

SEQ ID NO:5—similar to N-acetyl-glucosaminyltransferase I mRNA, mouse, human (enzyme located in the Golgi region in the cell; has been found as part of a DNA containing virus)

SEQ ID NO:6—similar to calcyclin, mouse, human, reverse complement (cell cycle regulated gene)

SEQ ID NO:7—contains sequence similar to: LOCUS AA254809 364 bp mRNA EST DEFINITION mz75a10.r1 Soares mouse lymph node NbMLN Mus musculus cDNA clone 719226 5'

SEQ ID NO:8—contains a sequence similar to No SW:RSP1_MOUSE Q01730 RSP-1 PROTEIN SEQ ID NO:9—contains 5' UTR of gb|U25435|HSU25435 Human transcriptional repressor (CTCF) mRNA, complete cds, Length=3780

SEQ ID NO:38—similar to cDNA of retroviral origin

SEQ ID NO: 50—trapped AYU-6 genetic element

Isolation of Cellular Genes that Suppress a Malignant Phenotype

We have utilized a gene-trap method of selecting cell lines that have a transformed phenotype (are potentially tumor cells) from a population of cells (RIE-1 parentals) that are not transformed. The parental cell line, RIE-1 cells, does not have the capacity to grow in soft agar or to produce tumors in mice. Following gene-trapping, cells were screened for their capacity to grow in soft agar. These cells were cloned and genomic sequences were obtained 5' or 3' of the retrovirus vector SEQ ID NO:76, SEQ ID NO:77, SEQ ID NO:78, SEQ ID NO:79, SEQ ID NO:80, SEQ ID NO:81, SEQ ID NO:82, SEQ ID NO:83, SEQ ID NO: 92, SEQ ID NO: 109, SEQ ID NO: 110, SEQ ID NO: 111, SEQ ID NO: 112, SEQ ID NO: 119, SEQ ID NO: 177, SEQ ID NO: 206, SEQ ID NO: 240, SEQ ID NO: 243, SEQ ID NO: 247, SEQ ID NO: 321, SEQ ID NO: 328, SEQ ID NO: 329, SEQ ID NO: 330, SEQ ID NO: 331, SEQ ID NO: 334, SEQ ID NO: 335, SEQ ID NO: 336, SEQ ID NO: 408, SEQ ID NO: 411, SEQ ID NO: 412, SEQ ID NO: 413, SEQ ID NO: 414. All of the clones designated with an "x" in the lab designations set forth throughout this application represent genes involved in tumor progression. All of the cell lines behave as if they are tumor cell lines, as they also induce tumors in mice.

Of the cell lines, two are associated with the enhanced expression of the prostaglandin synthetase gene II or COX 2. It has been shown that disruption of gene function by retroviral targeting of an upstream gene has lead to increased expression of a downstream gene product, COX 2. When a small molecule inhibitor of COX 2 enzyme was added, reversion of the transformed phenotype occurred. The COX 2 gene has been found to be increased in pre-malignant adenomas in humans and overexpressed in human colon cancer. Inhibitors of COX 2 expression also arrests the growth of the tumor. One of the cell lines, x18 (SEQ ID NO:177) has disrupted a gene that is represented in the EST (dbest) database.

(SEQ ID NO:76): >02-X18H-t7 . . . , identical to: gb|W55397|W55397 mb13h04.r1 Life Tech mouse brain Mus at 1.0e-114. x18 has also been sequenced from the vector with the same EST being found. (SEQ ID NO:77): >x8_b4_2 . . . (SEQ ID NO:78): >x7_b4. (SEQ ID NO:79): >x4-b4. (SEQ ID NO:80): >x2-b4 . . . (SEQ ID NO:81): >x15-b4. (SEQ ID NO:82): >x13-re . . . , reverse complement. (SEQ ID NO:83): >x12_b4.

Each of the genes from which the provided nucleotide sequences is isolated represents a tumor suppressor gene. The mechanism by which the disrupted genes other than the gene comprising the nucleic acid which sequence is set forth in SEQ ID NO:76 may suppress a transformed phenotype is at present unknown. However, each one represents a tumor suppressor gene that is potentially unique, as none of the genomic sequences correspond to a known gene. The capacity to select quickly tumor suppressor genes may provide unique targets in the process of treating or preventing (potential for diagnostic testing) cancer.

Isolation of Entire Genomic Genes

An isolated nucleic acid of this invention (whose sequence is set forth in any of SEQ ID NO:1 through SEQ ID NO: 418), or a smaller fragment thereof, is labeled by a detectable label and utilized as a probe to screen a rat genomic library (lambda phage or yeast artificial chromosome vector library) under high stringency conditions, i.e., high salt and high temperatures to create hybridization and wash temperature 5-20° C. Clones are isolated and sequenced by standard Sanger dideoxynucleotide sequencing methods. Once the entire sequence of the new clone is determined, it is aligned with the probe sequence and its orientation relative to the probe sequence determined. A second and third probe is designed using sequences from either end of the combined genomic sequence, respectively. These probes are used to screen the library, isolate new clones, which are sequenced. These sequences are aligned with the previously obtained sequences and new probes designed corresponding to sequences at either end and the entire process repeated until the entire gene is isolated and mapped. When one end of the sequence cannot isolate any new clone, a new library can be screened. The complete sequence includes regulatory regions at the 5' end and a polyadenylation signal at the 3' end.

Isolation of cDNAs

An isolated nucleic acid (whose sequence is set forth in any of SEQ ID NO:1 through SEQ ID NO:418, or a smaller fragment thereof, or additional fragments obtained from the genomic library, that contain open reading frames, is labeled by a detectable label and utilized as a probe to screen a portions of the present fragments, to screen a cDNA library. A rat cDNA library obtains rat cDNA; a human cDNA library obtains a human cDNA. Repeated screens can be utilized as described above to obtain the complete coding sequence of the gene from several clones if necessary. The isolates can then be sequenced to determine the nucleotide sequence by standard means such as dideoxynucleotide sequencing methods.

Serum Survival Factor Isolation and Characterization

The lack of tolerance to serum starvation is due to the acquired dependence of the persistently infected cells for a serum factor (survival factor) that is present in serum. The serum survival factor for persistently infected cells has a molecular weight between 50 and 100 kD and resists inactivation in low pH (pH2) and chloroform extraction. It is inactivated by boiling for 5 minutes [once fractionated from whole serum (50 to 100 kD fraction)], and in low ionic strength solution [10 to 50 mM].

The factor was isolated from serum by size fraction using centriprep molecular cut-off filters with excluding sizes of 30 and 100 kd (Millipore and Amnicon), and dialysis tubing with a molecular exclusion of 50 kd. Polyacrylamide gel electrophoresis and silver staining was used to determine that all of the resulting material was between 50 and 100 kd, confirming the validity of the initial isolation. Further purification was performed on using ion exchange chromatography, and heparin sulfate adsorption columns, followed by HPLC. Activity was determined following adjusting the pH of the serum fraction (30 to 100 kd fraction) to different pH conditions using HCl and readjusting the pH to pH 7.4 prior to assessment of biologic activity. Low ionic strength sensitivity was determined by dialyzing the fraction containing activity into low ionic strength solution for various lengths of time and readjusting ionic strength to physiologic conditions prior to determining biologic activity by dialyzing the fraction against the media. The biologic activity was maintained in the aqueous solution following chloroform extraction, indicating the factor is not a lipid. The biologic activity was lost after the 30 to 100 kd fraction was placed in a 100° C. water bath for 5 minutes.

Isolated Nucleic Acid

Tagged genomic DIAS isolated were sequenced by standard methods using Sanger dideoxynucleotide sequencing. The nucleotide sequences of these nucleic acids are set forth herein as SEQ ID NO: 1 to 428 (SEQ ID List 1). The sequences were run through computer databanks in a homology search. Sequences for some of the "6b" sequences [obtained from genomic library 6, flask b] (i.e., SEQ ID NO:37, 38, 39, 42, 61, 65, 66, 69) correspond to a known gene, alpha tropomyosin, and some of the others correspond to the vacuolar-$H^+$-ATPase. These sequences are associated with both acute and persistent viral infection and the cellular genes which comprise them, i.e., alpha tropomyosin and vacuolar-$H^+$-ATPase, can be targets for drug treatments for viral infection using the methods described above. These genes can be therapy targets particularly because disruption of one or both alleles results in a viable cell.

Identification Tags for Isolated Nucleic Acids

Genomic sequences, tagged with a vector, such as the U3 gene trap vector, are given a number corresponding to the genomic library of mutant cells from which the sequence was isolated, and a letter indicating a unique member of the library. More than one sequence with the same number and letter indicates multiple, unique sequences obtained from the genome surrounding the vector insert that "tagged" the gene. Such genomic sequences are obtained using vector-based primers, from which sequencing occurs 3' to 5' or 5' to 3'. In the former case, to recover the orientation of the gene into which the vector inserted, the sequence derived from the vector primer must be reversed and complemented. Such reverse complement sequences are designated "rE". In the case of genome sequencing from a primer that occurs 5' to 3' (i.e. the primer is at the 3' end of the vector), no changes are needed, since the derived sequence is the sequence as it appears in the gene disrupted. Such sequences are designated "B4". Homologies indicated below each genomic sequence are in the positive direction, unless explicitly noted to be on the negative strand. As an example, SEQ ID NO. 110 comprises a nucleic acid sequence encoding a novel polypeptide on the positive strand, while the negative strand encodes ferritin.

The SEQ ID NOs and the lab designations for additional genes identified using the methods of the present invention appear below.

---

| | |
|---|---|
| 84 | 32-3-2#1E/-rE |
| 85 | L191B2E#1-RE |
| 86 | L191B2E#3+-rE |
| 87 | 21-5-9E-RE | homology to: emb/AL021154/HS15005 human DNA sequence

| | |
|---|---|
| 88 | 14A14E-rE |
| 89 | 4cx-b4 |
| 90 | 5a-b4 |

-continued 91  6BSA12-B4
92  X7B/B4
93  x27b4f_1
94  12C#A-rE
95  10-3b(5/2/96)/-rE
96  10_4B_4-rE
97  6BE60-rE
homology to: alpha-trophomyosin
98  19D3E-rE
99  L19D16E-rE
100  2b_rE
101  14_24_#6-rE
102  7A7'-rE
homology to: annexin II/dynein I
103  L12cx#6-rE
homology to: gb: X51760 human zinc finger protein ZFP-36
104  L12cx#11-rE
105  19D5E-rE
homology to: 6-pyruvoyl-tetrahydropterin synthase (gb/M77850/RAT6PTHS)
106  12_3b#7-rE
107  12_3B#8-RE
homology to: gb/AA871174/vq32a08.r1 Barskad bowel MPLRBg *Mus musculus* cDNA
clone 10959265'
108  9B27-2-E
homology to: RAT LOCUS RNU53922 04-MAY-1996; *Rattus norvegicus* DnaJ-like
protein (RDJ1) mRNA, complete Cds, ACCESSION U53922 (on negative strand)
109  x15-rE
110  X11-rE
homology to: ferritin H (on the negative strand)
111  X20-rE
homology to: LOCUS RATGL5A Rat NICER element (GL5-14)5' long terminal
repeat, Acc. No. M59028 M33535N1D
112  X4-rE
113  14A7E-rE
homology to: MMSMAD7 3681 bp mRNA ROD 31-JUL-1998 DEFINITION *Mus musculus* mRNA for Mad-related protein Smad7, 149 bases
114  14A13E-rE
115  14_7#2E-rE
homology to: N-acetylglucosaminyltransferase I
116  12CX#6-rE
homology to: gb|AA522204|AA522204 vf98g09_r1 Soares mouse mammary gland
NbMMG *Mus musculus* cDNA clone 851872; also 5' similar to gb X51760 zinc
finger protein ZFP-36 (HUMAN), gb L20450 *Mus musculus* DNA-binding protein
mRNA, complete cds (MOUSE); Length = 442, 925 bases (shares homology with
SEQ ID NO: 20)
117  12C_2B#9E-rE
118  12CX#11E-rE
119  x5-rE
120  8C5_11-rE
121  191E2E-rE
122  19_7AE-rE
123  19_9BE-rE
homology to: LOCUS HS347M6 56583 bp DNA PRI 14-JAN-1998 Human DNA
sequence from PAC 347M6 on chromosome Xq22, CSTF2 (Cleavage Stimulation
Factor, CF-1, Polyadenylation Factor) 64 kD subunit gene
124  191E9E-rE
125  191E8E-rE
126  14C_2E/-rE
homology to: gb/H31084/EST104778 *Rattus* sp. cDNA-5' end similar to signal
recognition particle subunit(19 kDa) (on negative strand)
127  14H1E-rE
128  14G3E-rE
129  14G_2E-rE
130  6_3_6_2E/-rE
homology to: *Rattus norvegicus* cis-golgi gp130 (on negative strand); and
a HUMAN EST (on positive strand) AI127398; qb70g11.x1 Soares fetal heart
NbHH19W *Homo sapiens* cDNA clone (1705508 3' mRNA sequence)
131  14H4E/-rE
132  18A_8_4E-rE
133  18A_8_1E-rE 134 SCB2__19E-rE
135 L197B3E-rE
136 L195C5E-rE
homology to: *H. pylori* and *C. jeuni*
137 21__5__7E-rE
homology to: id3 gene; emb|AL021154|HS15OO5 Human DNA sequence from clone 15OO5; HTGS phase 1 [*Homo sapiens*]; containing the E2F2 gene for transcription factor E2F-2 and the ID3 gene for Inhibitor of DNA binding 3 (dominant negative helix-loop-helix protein), 1R2, Length = 133667, 971 bases
138 L195B1E-rE
homology to: vK72b07.s1 Knowles Solter mouse 2 cell *Mus musculus* cDNA clone 960181 5'
139 L194c4E-rE
140 L193A1E#A-rE
141 L192A3E-rE
142 L1739E-rE
143 L192B3E#13-rE
contains sequence identical to: insulin growth factorII/mannose-6-phosphate receptor
144 3 2 4 rE
located in the same region of the genome as calcyclin, but the gene is "read" in the opposite direction
145 36 7 1 a-rE
146 36 5 1 4 a-rE
147 34 25 5a-rE
rat satellite DNA (RATRSSID 93 bp, ROD 12-MAR-1984)
148 34 24-126/rE
homology to:
HSU49928 (3096 bp mRNA) PRI 06-APR-1998, *Homo sapiens* TAK1 binding protein (TAB1) mRNA, complete cds, ACCESSION U49928 NID g1401125, and HS333H23 (142274 bp DNA) HTG 17-JUL-1998 Human DNA sequence
149 34 23-1/rE
150 36 5 2-6/rE
151 36 5 2-196/rE
152 34 23-3/rE
homology to: gb|L16546|RATAP1X Rat P-glycoprotein (mdr1b) gene
153 34 25 23-rE
154 36 5 2-196/rE
155 31 3 9/rE
homology to: AA798638 568 bp mRNA EST 10-FEB-1998, vw34b06.r1 Soares mouse mammary gland NbMMG *Mus musculus* cDNA clone1245683 5, mRNA sequence, 824 bases.
156 31 3 6-2-rE
157 31 3 17-rE
158 31 3 5-rE
homology to: AF046001 2347 bp mRNA PRI 19-FEB-1998, *Homo sapiens* zinc finger transcription factor (ZNF207) mRNA, complete Cds, 833 bases.
159 31 3 15#1/rE
160 24 3 5#1/rE
161 31 4 4#1/rE
162 31 3 19#2/rE
163 31 4 5#1/rE
164 24 9 3#2/rE
165 L24__26__1-BL
homology to: AI045472 396 bp mRNA EST 06-JUL-1998, UI-R-C1-jz-h-09-0-UI.s2 UI-R-C1 *Rattus norvegicus* cDNA cloneUI-R-C1-jz-h-09-0-UI 3', mRNA sequence.
166 L24__26__1-B4
167 L22__5A1/rE
168 L24__3__2B/rE
169 L24 4-2/rE
170 L24 5-2/rE
171 L24 5-3/rE
172 (15-)L28AP/rE
173 L24 26-10/rE
homology to: LOCUS R06687 403 bp mRNA EST 03-APR-1995; yf10a10.r1 Soares fetal liver spleen 1NFLS *Homo sapiens* cDNA clone 126426 5'
174 L24 26-2A/rE
175 L24 26-2B/rE
homology to: gb|AA590026|AA590026 vm22g03.r1 Knowles Solter mouse blastocyst B1 *Mus musculus* cDNA clone 990964, 459 bases, 139A; and *Rattus norvegicus* Eker rat-associated intracisternal-A particle element
176 14 7#2E-rE
homology to: N-acetylglucosaminyltransferase I; this sequence shares homology with SEQ ID NO: 32.
177 x18
178 31__3__9-rE
179 31__3__6__2-rE

| | | |
|---|---|---|
| 180 | 31_3_17-rE | |
| 181 | 31_3_15#1-rE | |
| 182 | 24_3_5#1-rE | |
| 183 | 31_4_4#1-rE | |
| 184 | 31_3_19#2-rE | |
| 185 | 31_4_5#1-rE | |
| 186 | 24_9_3#2-rE | |
| 187 | 14XD#12E-rE | |
| 188 | 70A-rE | |
| 189 | 31-3-4-rE | |
| 190 | 3_6_9-NeoG-rE | |
| 191 | 31_4_2-rE | |
| 192 | 3_2_13-rE | |
| homology to: calcyclin | | |
| 193 | 3_2_4-E | |
| 194 | L25-10/-rE | |
| homology to: calcycin | | |
| 195 | L24-4-3/-rE | |
| 196 | L24-9-1-rE | |
| rat id sequence | | |
| 197 | 17-L25-27#7-rE | |
| homology to: calcyclin | | |
| 198 | L21C1E-rE | |
| homology to: calcyclin | | |
| 199 | L24-5-3BE-rE. | |
| homology to: | | |
| LOCUS H32572 310 bp mRNA EST 08-SEP-1995 EST107805 Rat PC-12 cells, untreated *Rattus* sp cDNA 5' end, ACCESSION H32572, and LOCUS AA858747 470 bp mRNA EST 10-MAR-1998 UI-R-A0-bb-e-01-0-UI.s1 UI-R-A0 *Rattus norvegicus* cDNA clone UI-R-A0-bb-e-01-0-UI, 3' similar to gb\|AA473081\|AA473081 vd44b07-r1 Barstead MPLRB1 *Mus musculus* cDNA clone 803413 5' mRNA sequence | | |
| 200 | L24-4-2BE-rE | |
| homology to: LOCUS MMU51002 6495 bp DNA ROD 16-JAN-1997 *Mus musculus* Dlx-2 gene, complete cds, ACCESSION U51002 NID g1477589 | | |
| 201 | 17-3-3B-B4 | |
| 202 | L24-26-3/-rE | |
| homology to: RNU23776, DNA ROD 10-AUG-1995, *Rattus norvegicus* Eker rat-associated intracisternal-A particle element | | |
| 203 | 12_2B#2-rE | |
| 204 | 05-17-3-3He-1-T7 | |
| 205 | 21_5_8E-rE | |
| homology to: emb\|AL021154\|HS150O5 Human DNA sequence from clone 150O5; 1p36_13-36_22, contains the E2F2 gene for transcription factor E2F-2 and the ID3 gene for Inhibitor of DNA binding 3(dominant negative helix-loop-helix protein, 1R2, Length = 133667, 971 bases | | |
| 206 | X18H-t7 | |
| 207 | 18A_8_4E-rE | |
| 208 | L24-5-2BE-rE | |
| 209 | L24-4-2AE-rE | |
| 210 | L24-10-1BE-rE | |

Properties of Genes Necessary for Viral Infection

The methods of the present invention have identified imprinted genes such as IFG2r (Lab Designation L192b3E##13-rE (SEQ ID NO: 143)) and CTCF (paternally imprinted) which regulates IGF2 transcription (Lab Designation 6BE72_rE (SEQ ID NO: 2).

Also, of 120 clones selected for virus resistance, 6 genes (16 cell clones) were selected more than once from separate libraries. Calkylin was selected 10 times. In addition to calcyclin, other clones were disrupted more than once. The statistical difference between virus selected and random insertional events by test of proportions is $p<5\times10^{-5}$ Data also showed that HSV-1 reporter expression is enhanced in two cell clones. S100A6 (Lab Designation 3_2_13_rE (SEQ ID NO: 192)) and Annexin II (Lab Designation 7A7'-rE (SEQ ID NO: 102)) are the sequences disrupted in these clones. They are part of the same pathway and may bind to each other.

The present invention has also identified genes whose products are related by binding. For example Lab Designation 6B371H (SEQ ID NO: 65) has the anxI gene disrupted. Lab Designation 6B60 (SEQ ID NO: 237) has the TPM1 gene disrupted. Lab Designation 7A7'-rE (SEQ ID NO: 102)) has the anxII gene disrupted. Lab Designation 3_2_13 (SEQ ID NO: 192) has the S100A6 gene disrupted. Lab Designation 32_3_2#1E (SEQ ID NO: 84) has the cam2 gene disrupted. Lab Designation L24_5_3BE (SEQ ID NO: 199) has the TUSP gene disrupted. Lab Designation 31_3_15#1 (SEQ ID NO: 159) has the fkbp8 gene disrupted. Lab Designation 24_9_3#2 (SEQ ID NO: 164) has the cpr8 gene disrupted.

Data also showed that mutant cell clones can have an altered level of expression of the disrupted gene. For example, in the S100A6 clone (Lab Designation 3_2_13-rE (SEQ ID NO: 192)) S100A6 expression is decreased. For another clone, the P162 (eif3s10) (Lab Designation 12PSA#6_rE (SEQ ID NO: 4)) expression is increased. In yet another clone, TPM1 (Lab Designation 6b60_Lac (SEQ ID NO: 237)) expression has altered transcript size.

Overall, the genes disrupted by the methods of the present invention are varied and belong to several categories of protein families. This invention provides DNA binding proteins (znf207, HP1-BP74, HAT1); RNA Binding Proteins (zpf36, eif-3, CSTF); Metabolic enzymes (vacuolar H+ ATPase [16 and 31 kDa], GnT-1 [N-acetylglucosaminaltransferase); retrotransposons (intracisternal A element rat retroviral sequence); cell surface/matrix proteins (alpha-tropomyosin (TPM1)); signal transduction proteins (TAK1 and smad-7)); and molecular trafficking proteins (gm130, m6p/igf2r, annexin I, annexin II, annexin III, calcyclin, JWA, ERBIN, ABC-cassette [mdr1] and DnaJ.

Example II

Identification of Genes in IGF2 Pathway

To conduct a systematic screen for virus susceptibility genes, a gene entrapment approach, was developed to select intestinal epithelial cells (Blay & Brown (1985a); Blay & Brown (1985b)) resistant to reovirus-induced cell lysis. One of the selected reovirus-resistant clones overexpresses insulin growth factor-2 (IGF2) (Bell et al. (2000)) due to an inserted mutation in the CTCF transcriptional regulators. IGF2 overexpression was found to be sufficient for resistance to reovirus infection. In addition, the selected clone displayed a transformed cell phenotype by its ability to proliferate in soft agar$_6$. Thus, gain-of-function mutations in the IGF2 signaling pathway confer resistance to lytic viral infections and potentially contribute to carcinogenesis.

Libraries of RIE-1 cells created by random mutagenesis by a promoter-trap vector7 were used to select survivors following lytic reovirus infection. RIE-1 cells were mutagenized by using the U3NeoSV1 gene trap shuttle vector described herein and the resulting libraries of mutagenized cells were infected with reovirus serotype 1/Lang, MOI=35, to select for clones resistant to lytic infection. Persistently-infected (PI) cells (Ahmed (1977)) created following reovirus type 1 infection were found to require a serum survival factor Since PI cells provide a non-genetic mechanism by which RIE-1 cells can acquire resistance to lytic infections$_9$, reovirus-resistant clones were selected in serum free medium to remove PI survivors.

The isolated clones did not express reoviral antigens, and did not produce infectious virus as assessed by plaque assay, suggesting these reovirus resistant clones are not PI. Regions of 3 genomic DNA adjacent to the U3NeoSV1 provirus in each virus resistant clone were isolated by plasmid rescue and sequenced. Altogether, of the 130 isolated clones 62% of flanking sequences matched known or presumptive genes, and an additional 23% were represented in the public databases of expressed sequence tags (dbEST) or non-redundant sequences (nr). From the 90 clones matching known or presumptive genes, 8 genes are represented more than once. Many of the disrupted genes have known or imputed functions, and several are known to function in the same or related pathways. The library included 4 independent mutations of which three genes were associated with the insulin growth factor-2 (IGF2) signaling pathway, namely, the IGF2/mannose-6-phosphate receptor (IGF2/mpr)$_{10,11}$, the insulin growth factor binding protein (IGFBP) 5 protease (Trss11)$_{12}$, and the CTCF gene$_{13,14}$ (clone 6b72). CTCF differentially represses maternal IGF2 gene expression, whereas the imprinted paternal gene escapes repression due to methylation of CTCF binding sites.

Levels of CTCF protein in 6b72 cells were reduced by about 50% as assessed by western blot analysis, consistent with the disruption of one allele. Diminished CTCF expression was associated with an increase in IGF2 transcripts as assessed by Northern blot. In addition, two products were amplified from 6b72 cells by RT-PCR using primers that flanked the IGF2 coding sequence. The first product was identical to the rat IGF2 sequence (Genbank Accession No. X17012), whereas, the second contained 14 additional nucleotides due to differential splicing of exon 2 to an alternative splice acceptor located upstream of exon 3. The alternative transcript encodes an abnormal protein consisting of the first 11 amino acids of the E-peptide appended to 60 amino acid residues without homology to any known protein. To examine whether increased expression of IGF2 in the 6b72 clone is associated with cellular resistance to reovirus infection, RIE-1 and 6b72 cells were infected with reovirus type 1, MOI=10. There was approximately a 90% decrease in titer of reovirus obtained from infection of the 6B72 clone compared to RIE-1 cells at 24 hours post-infection ($4.5 \times 10_5$ versus $5.1 \times 10_6$) that was maintained at 48 hours. Additionally, there was a dramatic difference in the survival of 6b72 cells after being exposed to high titers of reovirus type 1. To determine whether IGF2 confers the property of resistance to lysis with reovirus, cell clones overexpressing the IGF2 gene and its splice variant were generated. Cells were examined for their capacity to resist lytic infection with reovirus. Over-expression of wild type, but not the splice variant IGF2 in RIE-1 cells increased the resistance of cells to reovirus infection by over 100 fold. However, when the splice variant IGF2 was transfected into 6b72 cells, the ability of 6b72 cells to survive infection was abolished. Over expression of the IGF2 gene in reverse orientation resulted in a slight difference in the capacity of 6b72 cells to resist infection. These studies suggest that increased IGF2 expression in 6b72 cells is associated with their capacity to resist lysis by reovirus infection, and that the splice variant IGF2 encodes a dominant negative isoform that blocks the effect of IGF2. There is accumulating evidence suggesting that overexpression of IGF2 associated with relaxation of IGF2 genomic imprinting is associated with tumor formation. To determine whether the 6b72 cells differ in their rate of cell cycling compared to wild type cells we examined the incorporation of MTS/PMS. It was found that there was no alteration in cell cycling (data not shown). RIE-1 cells do not have the capacity to proliferate in soft agar, a surrogate for the ability to form invasive tumors in rodents$_{6,15}$. It was found that 6B72 cells that have a disrupted CTCF gene develop the capacity to proliferate in soft agar To determine whether IGF2 confers this phenotype, cells that were transfected with the IGF2 wild type and its gene variant were examined. 6b72 cells that overexpress the IGF2 gene were found to grow in soft agar. Forced expression of either the splice variant IGF2 or an antisense IGF2 abrogates the ability of 6b72 cells to grow in soft agar. Thus, the variant IGF2 appears to act as a trans-dominant inhibitor of IGF2 in this assay. Finally, as anticipated, there was no phenotype associated with overexpressing the splice variant IGF2 gene in the parental RIE-1 cells. The capacity to proliferate in soft agar is not a property of other reovirus-resistant clones that contain mutations in the IGF2 pathway Thus, cell clones with disrupted IGF2 receptor (IGF2/mpr) or IGF2BP 5 protease (prss11) genes did not proliferate in soft agar. Annexin II (anxa2) is involved in cytomegalovirus replication[16] and binds to the insulin and insulin growth factor-1 receptors[17]. A clone with a disrupted anxa2 was found in our library, also failed to grow in soft agar. Therefore, the capacity to proliferate in soft agar is not a general property of cells that are resistant to reovirus, even in clones that contain genes disrupted in the IGF2 or related pathways.

Insertional mutagenesis provides an approach to identify genes associated with selectable cellular phenotypes. In the present study, one clone resistant to reovirus lytic infection contained a provirus inserted into the CTCF transcriptional regulator and overexpressed IGF2. CTCF binding motifs are present in many genes, including IGF2[18]/H19[19], and c-myc[20]. However, since 3 other clones selected for reovirus resistance contained mutations in the IGF2 pathway, the role of IGF2 in virus-resistance was investigated further. Forced overexpression of the IGF2 gene in the parental RIE-1 cell was sufficient to confer cellular resistance to lytic reovirus infection. By inference, inserts affecting other genes in the IGF signaling pathway suggest that mutations in multiple genes may affect the same phenotype by acting on a common pathway.

As the entry, disassembly, transcription, translation, and repacking of viruses share common features; it is possible that common cellular pathways will influence infection by other virus families. The present study is the first to show a direct connection between IGF2 gene expression and virus infection.

The data presented herein also suggests that the level of IGF2 expression correlates with the capacity of cells to proliferate in soft agar, a surrogate for the establishment of invasive cell growth. In addition, this invention has defined a novel dominant negative variant that shares virtually the entire sequence of the mature hormone, but lacks a major portion of the E-peptide.

Entrapment Mutagenesis and Selection of Reovirus Resistant Clones

To identify genes that may interfere with reovirus' lytic infection, a gene trap retrovirus shuttle vector, U3NeoSV1, was used to generate mutagnized rat intestinal (RIE-1) cells[1]. A library of mutagenized RIE-1 cells were generated following infection of the vector, multiplicity of infection <0.1, and selection in media containing G418 sulfate (0.7 mg/ml) (Clontech, Palo Alto, Calif.), 1 mg/ml[1]. Twenty libraries of mutant RIE-1 cells, each consisting of $10_4$ independent U3neoSV1 vector insertions, were generated and expanded until each mutational event was represented by a sub line of approximately $10_3$ sibling cells. These cells were plated at low density and incubated in serum-free media for 3 days until they became quiescent, infected overnight with reovirus serotype 1 at a multiplicity of infection of 30 plaque forming units (pfu) per cell. The infected cells were detached with trypsin, DMEM medium containing 10% fetal bovine serum (PBS) (Hyclone Laboratories, Inc., Logan, Utah) was added and the cells were allowed to reattach. After 4-6 hours the medium was replaced with serum-free medium and the cells incubated for several days until there was microscopic evidence of only a few cells attached to the plastic of the flask. Cells that survived the selection were transferred to cell culture plates in media containing 10% FBS and cells were divided for extraction of DNA and freezing Identification of Genes Disrupted by Gene Entrapment To identify the gene disrupted by the vector in clones surviving reovirus infection, the shuttlevector property of U3NeoSV1 was utilized. Regions of genomic DNA adjacent to the U3NeoSV1 provirus insertions in clones resistant to reovirus lytic infection were sub cloned by plasmid rescue, and sequenced1. Sequencing was done using an automated sequencer (ABI 3700 DNA Analyzer, Applied Biosystems, Foster City, Calif.), and the results obtained were compared to databases available in the public domain (BLAST nr, est. and hgts). The probability of a match to sequences in the databases occurring by chance alone varies due to interspecies conservation and the length of the match. Matches to characterized genes were considered significant if the probability score was $p<10_{-5}$ and involved non-repetitive sequences. As indicated, virtually all of the genes identified had matches to murine, rat, or human gene sequences with $p<10_{-10}$.

IGF2 Expression was Assessed by Northern Blot Hybridization

Total RNA was isolated from cultured cells using Trizole reagent (Gibco/BRL). 5 mg of RNA was separated on 1.2% agarose gel, and transferred to a Nitrocellose membrane. Membranes were hybridized with random prime-labeled (Strategene) probes corresponding to a full length of IGF2 cDNA and a b-actin cDNA.

IGF2 cDNA Isolation and Expression

Rat IGF2 cDNAs were obtained using reverse transcriptase PCR (RT-PCR). Total RNA was extracted from RIE and 6B72 cells using Trizole reagent (Life Technologies, Rockville, Md.). RT was performed on 1 mg of total RNA (PTC-100 programmable Thermal Controller, MJ Research. Inc, Watertown, Mass.). A pair of primers was designed according to rat sequences: CTTCCAGGTACCAATGGGGATC (forward) (SEQ ID NO: 429) and TYTGGTTCACTGATGGTTGCTG (reverse) (SEQ ID NO:430). A 500 bp DNA was amplified under following conditions: 95° C., 1 min; 40 cycles of 95° C. 30 seconds, 60° C. 30 seconds and 68° C. 3 minutes; 68° C. 10 min; 4° C.

Immunoblotting Analysis

Cells were washed with PBS and lysed in SDS Lamelli buffer. Protein concentration was determined using the bicinchoninc acid protein assay (Sigma, St. Louis, Mo.). 20 mg of protein extract was loaded in each lane of a 10% SDS-PAGE and run at 100 V. Protein was transferred to a nitrocellulose membrane at 22V overnight at 4° C. The membrane washed three times with TBST (50 mM Tris pH 7.5, 150 mM NaCl, 0.05% Tween 20) and then incubated in blocking buffer (TBST and 5% nonfat dry milk, pH 7.5) for 1 hour at room temperature. The membrane was then incubated with anti-mouse, CTCF (1:500, BD Transduction laboratories) and b-actin (1:3000, Sigma) in blocking buffer overnight at 4° C.

Following washing (×3), the membranes were incubated with goat anti-mouse secondary antibody (1:20,000, Jackson ImmunoResearch Laboratories, West Grove, Pa.) for 1 hour at room temperature, followed by three 15-min washings. Immune complexes were visualized by addition of chemiluminescence reagent (Renaissance, DuPont NEN, Boston, Mass.) and the membrane was exposed to Kodak XAR-5 film (Eastman Kodak Co., Rochester, N.Y.).

Transfection

Cells were cultured to semi-confluence and plasmids expressing wild type and variant IGF2 proteins were transfected into RIE and 6B72 cells using SuperFect Reagent (Qiagen, Inc. Valencia, Calif.) according to the manufacturer's protocol. After 48 hours, transfected cells were passaged, 1:10, into medium containing hygromicin (selective medium) at a concentration determined to kill 100% of non-transfected cells (150 mg/ml). Cells were maintained in selective medium until clones appeared.

Soft Agar Colony Forming Assay

Dual layers of sea plaque agarose were made with the bottom layer consisting of a 50:50 mixture of 1.6% agarose solution 1:1 and 2× medium. The bottom layer was allowed to set for 4 hours, and then a 50:25:25 solution consisting of 2× medium, 1.6% stock agarose, and 1× medium containing cells, at a final concentration of 5000 cells/ml, was vortexed in a conical tube, and 2 ml was added to each well. Following 30 minutes at room temperature to allow the upper layer to set, plates were incubated at 37° C., 5% C02 incubator for 7-10 days and checked for colony formation by microscopy.

Cell Proliferation Assay

RIE-1, 6b72, or IGF2 transfected RIE-1 or 6b72 cells were seeded at 5×104 per well in 96-well plates, incubated at 37° C. and 5% CO2. At 4, 6, 18, 48 hours post plating, MTS/PMS, 20 ml per well (CellTiter 96 Aqueous Non-Radioactiver Cell Proliferation Assay, Promega, Madison, Wis.) was incubated for 2 hours, and then the absorbance was determined at 490 nm. Each set of conditions was repeated in triplicate.

Example III

*T. cruzi*

The methods of the present invention have identified cellular genes involved in the pathogenesis of *Trypanosoma cruzi* infection of mammalian cells. *T. cruzi* infects many cells including muscle cells and epithelial cells, among others. Insertional mutagenesis was utilized to isolate positional sequence tags that define regions of DNA that contain DNA that encodes for genes necessary for the infectious cycle of *T. cruzi*. In the process of characterization of genes that have functional roles in the replication of *T. cruzi* one PST was found that is essential for both *T. cruzi* and reovirus replication.

Chagas' disease affects millions of people in South and Central America. *Trypanosoma cruzi*, the protozoan which causes Chagas' disease must attach to mammalian cells before it can invade them. The disease is acquired when a host is infected by invasive trypomastigotes transmitted by an insect vector or during blood transfusion. Cases of blood transfusion-related Chagas' disease have been reported in the United States where the disease is not common. There are estimated to be more than 100,000 infected persons residing in the United States, and it has been suggested that cases will be encountered in increasing numbers. Trypomastigotes attach to and penetrate mammalian host cell membranes to multiply intracellularly as amastigotes. Amastigotes then transform into trypomastigotes that are released from these cells to infect neighboring cells and disseminate in the body.

The methods of the present invention were used to select cell mutant clones of rat intestinal epithelial cells (RIE-1) that are resistant to *T. cruzi* infection using gene trap retroviruses. For this purpose, RIE-1 cells were randomly mutagenized with a retroviral vector (U3 gene trap) containing neomycin and ampicillin resistance gene markers. A library of gene trapped RIE-1 cells was infected with the highly invasive *T. cruzi* trypomastigote clone 20A at a ratio of 20 parasites per cell. Control monolayers of wild-type RIE-1 cells were also infected with the same density of *T. cruzi*. After several cycles of *T. cruzi* infection, cell lines were selected for their ability to be resistant to *T. cruzi* infection and then for their ability to be resistant to G418, a neomycin analogue that is cytotoxic to mammalian cells. These cell lines were cloned by limiting dilution and two clones named A:11:4:C5 and C:8:2:B4 were selected for further studies. It was found that A:11:4:C5 and C:8:2:B4 clones released very few trypanosomas, whereas wild-type RIE cells released many trypanosomas. Kinetics of infection of A:11:4:C5 and C:8:2:B4 clones and wild type-RIE-1 cells with *T. cruzi* indicate that mutant clones A:11:4:C5 and C:8:2:B4 do not support *T. cruzi* infection as indicated by the dramatically low number of intracellular parasites within these cells as compared to high level of infection seen in wild-type RIE-1 cells. This pattern of low *T. cruzi* infection seen in A:11:4:C5 and C:8:2:B4 clones is constant during the cycle of infection of *T. cruzi* in rat epithelial cells observed from 1 to 5 days. Further analysis of two cell clones demonstrate that the block in the parasite's infectious cycle occurs after the binding of the parasite into the mutant cells. It was shown that binding of parasites to the mutant cells is similar to the binding of parasites to the parental cells. However, entry of parasites into each cell line was diminished. For another mutant cell line, entry was similar to the parental cell, but the ability of the parasite to be released from the phagolysosome was dramatically affected.

To investigate this hypothesis the features of the gene-trap vector were manipulated to derive a rescued plasmid from each clone. The resistant (R) clone obtained by EcoR1 rescue and BamH1 rescue gave two plasmids representing over 10 kb of DNA. The downstream sequence has significant identity with several rat EST sequences identified and submitted to the gene bank on behalf of NIH's rat genome sequencing project.

The second clone is designated most resistant (MR) based on its quantitative resistance to intracellular *T. cruzi* infection as compared to the wild type cell line. The genomic sequence that was rescued from this clone is approximately 4.5 kb with significant homology to a protein phosphatase pp2a B' regulatory subunit gene. Because of several anomalies, the MR cell line was subcloned and from a pool of 50 clones MR-6C2 was selected, which again upon conducting plasmid rescues yielded a sequence with identity to the pp2a B' regulatory subunit. By reverse transcriptase followed by polymerase chain reaction (RT-PCR), using primers designed from the human pp2a B' regulatory subunit homologue, we have been able to show that the RIE wild type cell line expresses a pp2a B' regulatory subunit while the MR-6C2 clone does not amplify a product in parallel experiments. These data indicate that this gene is no longer expressed in the selected clone.

Several other clones have been isolated. One of these, 8B1, has the phenotype of diminished binding of parasites to the cell surface. By plasmid rescue, a sequence of genomic DNA was isolated that has a 100% homology to the rat lectin-like oxidized LDL receptor gene (LOX-1). The 1,6-kb genomic fragment gives 100% identity when sequenced with both Lac (5' distal) and Neo (5' adjacent to the vector) primers. The insertion resides at base #6120 in the reported sequence[19]. Our genomic fragment extends 5' to an EcoR1 site just prior to the TATA box of the promoter position (#4774). This positional sequence tag (PST) is consistent with the published report of the position of this restriction site. Analysis of the clone indicates that insertion has taken place into intronic sequence after the first exon and the rescued sequence appears to contain the coding sequence contributed by the first exon. The first exon is found at nts 4800-4937 of the rat genomic DNA for exon 1 and the promoter region. The vector resides at nt 6122 and the reporter gene would be expected to be transcribed from the same strand as the LOX-1 gene. The LOX-1 gene is 3.75 kb, and the organization of the downstream exons is not reported to the database.

```
MR-b4.., identity with est: EST230513
Normalized rat lung.
(SEQ ID NO: 419)
GTTAGGCCCTCTGAGTCCNTNACTACCCGTCAGCGGGGGTCTTTCACACC

CTTTACCTACCCACCCTGCATCCCAACATGTCATGTGGAAAAGTCCTCAT

TTTTTATATTGAGAAGGGTTTTTTGTTTGTTTGATTAATTTTTGATTTTT

CAGTGAANTCATTTTCTTTGTGTCAATACCTTTTTCTCTACACTTACCAG

GCTGTTGTAAGAAATAAACTGAGAAACATTTGATCTCTCCTCTTCCTCCA

CCAAGTGCTGACCCTCAGGCTGCACCACCAATAAATAGGGACCTGAAGAA

AGGAATGGGAGTTGTGTTTATTTAAAAAAAGATTAGACAGAAGGAATACG

TTTGGTGGATGTGTATTCAGG TTTGGTGGATGTGTATTCAGG

P4c5e/NeoC
(SEQ ID NO: 420)
CGATCCTCAGCTAGCTTG

CCAACCTACAGGTGGGGTCTTTCACCCTGTACCTGTTAAGCTCATCTCAC

CTCCCTGCCATTTTCTGGATGAATTCTTTGTCAAACCAATCTCAAGCCGT

TGGCAAAAATACTCTACAGCACTTCAAAGTGAAGTGCAATCATTTTTCTT

TTCTACCCCAGGAACACAAAGATTTTCCAGCACAATGTAGAACTGACGAG

AAATGGAGCAGGGGAACATCCAGCACACGAGCAGCTCTGAGGTGTGGGTG

TGTTAGCTCAAACTNCACTTNCCATAAAGTAGAGGTGAGGAGGACAGGGT

AACTTANAGGAGGCAGAAAGAAAACAACAGNATNATAGTTGACCCTGGGA

AGGGGCTCTACGTGTTGTGGGTGCTNGCAAACCCAGNTGGNCAATNAATG

CACTNCTACTNCATGGTGGCTTGAGGAAAGGGCTGGAGTNACTAAAGNCG

GGNTGAGGAGGGTGGATNATNGNGNCTGCAGATNGGNCCTGNTTGNAGGT

NGNNCTGNTGNGGNNTGTGGGGNAGACAGGATNGGGTGTGGGGGGGNTN

GNTGGGNTGGNANTGNCTGTGGNGNCCAGGNTGGGNTGGGNCTGGCNNGA

TGNTGNTGGCTGTGGNNTGNTGGGGGCTNGGNTTGAANGTGTGGCNCNGG

GNGGCNTNGGNTGNGGGNANGGGGNANGGGNTGNGTGGGGGGGAGTGGT
```

```
GGGGGGTGGGTGNNGGTGGGGGGNCCCTTGGGGGGNTNGGGGGTNGGNTN

ACGTGGCNNGNGTNGGGGAACTGNGNNGACGACGC
> gi|18846965|gb|AC109110.2| Rattus norvegicus clone
CH230-28... 688 0.0

P4C5c/LacO >
(SEQ ID NO: 421)>
TTTNCACAGAATNCAAGCCAGAGGCTCAAAAGTAAACCTACACATCCTGT

TCACAAAAGCACTGGGCACAATTGCTAGAGGCTAGAAGAAGCCCAAGTAT

CCACTTAACAGGTAAATGCCACACGCCTGCAGTGCCTTTGCTATTCACCT

GTCAGAGGGAAGGGAAGCCCGTTCATGCTGCAGCATGGGTGTTCTGCACA

GTGAAGAATGAACTATGGTGGCTGTGCTTTCCAGTTCCGATGAGTGGGCA

TTTAGGAGGCAAAGAGAGAGAGCACACAGCAGACTGAAGCAACCTGTA

GACAGCAAAAGCTCATCCAGTCAGGGCTCACAATAGCCAACAATAGAGAC

GACTACCGCAGCCTGATTGAAAGAGGGAGCAAAAGGCATCAAGTTGGTGC

TCACAACATCCCCCATGAGTCTGCTGTCGGANCAGTAGTCCTGCTGGAGT

TCTGAGTGGAGGGTCCTGGGCAGAGCANANCAGTCTCCATGGATGAGCTT

CATAGTCTGTTGCCAATGGTTACCTTCTAGCTGTTGTCAANAGCTTGTTT

TTACTGNCAAGATGTGTTGCTGTTGTCAATNCCCANACAANGGCCCTTAN

AGGACAATATGAGATAGGCATGGGTGGGCGTGAAATGGGGGGAAGGAGAG

GGGTNAATTGCANNTTGGCAAGGAGGGCANACANCACTTGNTGGCTGCTA

CACTNTATNGGGGAGGGGACCAAAGGNGCCATGANGAATGGTNNTGATGG

NANTTGCTTGAGGGGGCGTNGNAAAATANAAATNGGNAAAANGATTGTTT

NGCNTTTTTTTAANNNGANGGGTATGAATNNNNNTANACCTNGNGGNGG

GAAANANCN

> |gi|18846965|gb|AC109110.2| Rattus norvegicus
clone CH230-28... 605 e-170

P4C5c/NeoC..
(SEQ ID NO: 422)
CGATTTCTNAGCTACCTTGCCAACCTACANGTGGGGTCTTTCACCCTGTG

CCTGTTNAGCTCATCTGACACTGGCCTGCCATTNTNTGGATGAATTCTTN

GTNGAACCAATCTTAAGNCGGNGGATNAAATACTGNTACAGNAGCTNANN

AGTGAAAGCG
above sequence- first 46 are vector.

Note: this next gene is a LAC (5' not connected to
the vector sequence) of P8A3- it is in the Rat
tryptase 2 gene.>

>
P8A3a/LacO.., gb|AF011446|AF011446 Mus
musculus granzyme K
gene, complete cds

Length = 5747, 2e_99, and gb|L19694|RATRNKTT2A
Rattus norvegicus tryptase 2 mRNA, complete cds.
Length = 884, both negative strand.

>
(SEQ ID NO: 423)
TTCACAGAAACCTAGGGTGAAGGGTAAGGCTGGGGAAGTAAGGAATCTGC

AAATCCATCGTGAGTGCATACACGCAGAGTGTCCTCTGCAACATATCTGT

GCTTACTAAATGTGTCAGTTATTCTGAAATACCTTAAAAAATAAAAACAC
```

-continued
CAAGTGTCAAAACCGCACCAAGAAAGAGACAGTAACTTTCCCTTGCACCC

AGGCTTCCTTTCAGCAATTGCAGTTGCTTGTGGTCAACTGCTGTTGAAAG

ATTACATGAAATATTCCAGAGACAAATGATACATGCATTGAAAATTACAT

ATTAGAGTAGATTGATTGAATTGTGCTTTGATNGCCATTGTTAATCTTAC

TGTACTCAGGNNCTTGACTAGACTTTATGTTATGCGTGTCATTTATCCTG

GACATGGACCACCACATACATGGAAAAGCACAGGGGACTGACCGAGAGTA

GCANTGGGCCGGCTGNTANCACCCACTGCGGATGGATNANGACTGNCTGC

CAAATATNGTGGGCGGGGTGCTGGATGGAAGCCATAGAAGGCGTGNAATG

NGGNTNNNCT
> gi|3169700|gb|AF011446.1|AF011446 Mus musculus
strain 129/SvJ 216 2e-53 gi|8393512|ref|NM_017119.1| Rattus norvegicus
granzyme K (G... 66 4e-08
>

P8A3C/e.., reverse complement, 862 bases, 2600
checksum.
(SEQ ID NO: 424)
CCCCCCCCNCANNCCCCACACACCTCCCCCGCCNCCTTCACCCCANCNCA

GCCCNAGCCCCCNCNCCCACATTTCCACANCCCACCGNGCNTCTTTCCCA

GNNCGNATNTNTCCAANCAGNTCCCNCCACATCCNCCANCCCCCAGTNCA

CGGGGCCNCCCCATCCTNNCNGNCCCACAGGCCANCTTTNCCCCTGTCCC

CATTCCCCACCCTNCCTNTCATGNCCCCTNAGTANCNNTCANCAGCCACN

CTNCCCCTTNATCCCANCNCTGTGCACACCTTTTATTCCTGTGNCCCNCN

CCCAATGTCTCCCACCTTTCTGTTCCATTTTTCCCNCATAGTTCCCAANN

CNATTCTGGGNAAAAGCAGCCATCAAGGCCCACTTTATAGTCCANAATNC

TGGNCCTGCCTTNNAATGTCCTCCTATATTNAGTNACCGCACCGCCTTTA

AATCNACCATCATGCAAAGTGGCAGNATGCANACAAATTGTANAAAAGCT

CTTCGCCTGAGCAGCACTGTGGATCTCCTAGTNAAGTTGGAGTGTGTACA

CTACACCCCAATATCTTAGAAAATTCCCAAGAGAANACTTCATCTTTTCC

TCTATAAATTTGCAAGAGAATAAAAGGATGGTAAGACAATTATGCCAAAT

TAGACCTTTAATCAAGAGATTACAAATTATAATGTCTACTACCCTTCCTG

AATCTATGAAGAAAATTAAAAATACACTATAATAATATTCATAGTTGTTT

ATTTAGAGCATTTGCTTCTCAACTTTAAATATTAGTCTTTTATTTCTTTA

CGCCCATAATATCAGGAACCAGTGAAAGACCCCACCTGTAGGTTGGCAAG

CTAGCTGAGNAT
>

P8A3a/E.., reverse complement, 640 bases, 55F
checksum.
(SEQ ID NO: 425)
GGGNNNTNANGGAGNCNCGNGGCGCNCGGGCNTNGCCCGNTANCGNGGNGN

GCGGGGNGNGGAANNTNAGGNCNGNNAACAGAGGCGGNGNNGCGGCGCTG

GGNNNNGGNCCGGNNGGCCCGGNGGGTANAAGNNGAAGTGNTNAGNGGTG

GGGAGGNANNNGACGNTGGGNNCGANNNNCGCNGGGGANGTGAAGCCNGC

CNGTGCNGGGNAGNGGGCGGNNNTGGGGGNGNGGGCCANNNNCNGNATGA

GGNGATGNTGNGGNTGGGCGNAGGNNAGGCGGGCGNGTGGCGNGNNGCGG

TGGGGNGNGNNGGAANNGANNTGGCGNGCNNCCGAGGGNGNGATNCNNCG

CNCNGNGGAGGGNCNGGNGATGNGTCNNAGANGGTCGGNGGNNGGCNGGN

CAGNNCGTGCNGTNANGNCNTNGNGATCANNGAGGGTGNCCNNNGGNANG

AGTCTAGGGGCGGCCCTNTCGTNNATNCNANGNGGGCCGATTCNCGCATN

CGCNNATAATCATATTCCATAGTTGNTTATNTAGAGCATNNGCTTGTCAC

CTTTNAATATTAGTCTTTNATTTCTTNACGCCCATAANATCAGGNACCAG

TCGNAGACCCCACNTGTAGGTTTGGCAAGGGTNGCGAGNA

P8B1-E.., db|AB018097|AB018097S1 Rattus
norvegicus gene for lectin_like oxidized
low_density lipoprotein receptor, exon 1.,
rev, 827 bases, 1EA checksum.
(SEQ ID NO: 426)
TANAAAGANGNCANAAANGCNNCNTTCAGAGNCCCAAANNTATTTTGTGT

GTNNTNAAGNCTGCAAAAATGGGNAGTGTTTTGTNAGTATNTAAGCAGAT

TNGGTATATTCAGNCGGCCAAANANACATTAGACTCTTTGTCCATTGTTG

GCTTTAAAAATTGTAGCTTGTACTTCNCTATCCAGTAAACTTAATTACTT

ANGCTGAATAGATAACTCGATTCTGTAGAAAACTACAGGTAAAACATCTA

TTATTTTATAAAATCGAGAGAAAAAGGCCAGGTAGGTGCACACCTTTAAG

CCCAGCACTTGGGAGGCAGAGGCAGGTCACCTGCTCTACAGGGTGAGCTT

TAGGTCATCCAGGAATACACAGAGCAACCCTGACTCAGAANCAAACCCAA

AAAAAAAAAAAAAAGGAACAAATTGTAAGAAGAGGAAGAAAGGCATAG

TGTGTCTGTAAATAAGCCTGAAATCTCTCAGTGGGTAAGATAAGGCCGAG

TGTGGTGTGATTTAATGTCTGAGTGACTGAACTAGCTCAGAGTCAGGACA

GTGCTGGAGCTTGGTAGTAGACCCAGCAGCAGTGGAGCTAGCTTAGTGTG

AGAAAGTGCTGGTGTTTAGTAGTAGATGTAGGAGCTAGTACCACGTGTGA

ATTTGCTCAACCACTCATTCATTATTTGTGCAGTAAATATTGTTTTCTAA

CCTGACTTTTACCATAAATACAACTAGTTCTTCTTTAGGAGCCCTGGTTA

GACTATTTACTGTGGTATAAGCTATATACTGAAGTTAGTGTGAAAGACCC

CACCTGTAGGTTTGGCAAGGTAGCTAG
> gi|4008162|dbj|AB018097.1|AB018097S1 Rattus
norvegicus gene... 743 0.0
>
Sequence of homology with the vector sequence and
the LOX-1 genomic fragment.
dbj|AB018097|AB018097S1 Rattus norvegicus gene for
lectin-like oxidized low-density lipoprotein receptor, exon 1
Length = 8960
602601
Nucleotide, Related Entries, Protein, PubMed,
LinkOut
LOW DENSITY LIPOPROTEIN, OXIDIZED, RECEPTOR 1;
OLR1
>

LECTIN-LIKE OXIDIZED-LDL RECEPTOR 1; LOX1
OXIDIZED LOW DENSITY LIPOPROTEIN RECEPTOR 1
Gene map locus 12p13-p12

Endothelial cell dysfunction or activation elicited by oxidatively modified low density lipoprotein (Ox-LDL) has been implicated in the pathogenesis of atherosclerosis. Vascular endothelial cells internalize and degrade Ox-LDL through a putative receptor-mediated pathway that does not involve macrophage scavenger receptors (see MSR1; 153622). To identify genes encoding Ox-LDL receptors, Sawamura et al. (1997) transfected mammalian cells with a cDNA expression library derived from bovine aortic endothelial cells and assayed for uptake of labeled Ox-LDL. They recovered a cDNA encoding an Ox-LDL receptor, which they designated lectin-like Ox-LDL receptor-1 (LOX1). Immunofluorescence studies showed that bovine LOX1 is expressed on the cell surface. Sawamura et al. (1997) cloned a cDNA encoding the human homolog of LOX1 by screening a human lung cDNA library with the bovine LOX1 cDNA. Cells stably expressing human LOX1 showed uptake of labeled Ox-LDL. The predicted 273-amino acid human LOX1 protein is 72% identical to bovine LOX1. Its structure is similar to that of C-type lectins such as CD94 (KLRD1) and NKR-P1 (KLRB1). Northern blot analysis revealed that human LOX1 is expressed as a 2.8-kb mRNA in various tissues, with the most abundant expression in placenta. Yamanaka et al. (1998) determined that LOX1 is expressed in vascular-rich organs but not in lymphocytes.

Yamanaka et al. (1998) found that the LOX1 gene spans approximately 15 kb and consists of 6 exons. By fluorescence in situ hybridization, they mapped the gene to 12p12-p13, where genes of the natural killer cell receptors are clustered.

*Erlichia*

The selection methods of the present invention were used with a highly susceptible cell line that is commercially available, DH82 cells, that were obtained from the ATCC. The cells were infected with a vector of the present invention and a library was created of mutant cells. The mutant cell library was selected with *Erhlichia chaffeensis*, Arkansas strain, that was obtained from a laboratory sample from an infected individual. Surviving cells were re-exposed to the infectious agent, 1:100 infected to naïve cells [infection of naïve cells requires the presence of infected cells for infection-cell to cell contact]. A single cell clone was derived from a library of approximately 1 to 3000 unique inserts. The clone has a disrupted fastK gene.

The parental cells are susceptible to apoptosis during the course of *Ehrlichia chaffeensis* infection, whereas the mutant cells are not susceptible. However, chemically induced apoptosis is preserved in the mutant cell clone (susceptible to anti-neoplastic drugs). An expression cassette was created using a macrophage specific promoter and enhancer and the human fastK gene. It was found that the phenotype of *Ehrlichia* susceptibility can be complemented in the cells that express the transgene in its appropriate (positive) orientation. The transgene expressed in negative orientation did not have a phenotype with the mutant cell clone used as the recipient.

```
(SEQ ID NO: 427)
11-d11-erlichia sequence from dog, Rubin.Seq
LENGTH: 1101 CHECK: 332 ..,
reverse complement, 919 bases, 2339 checksum.
ACCGGAACCCCGTTTTTTNTTGNMNGGGNTTTAACCCNNATTTGGNGNCC

GGCCCCGGTNCNGGGNTTNNTGGAAAATGNCNNNCTCGNTGGCCTTCCNA

TTAANANGCCNNGGGGAAGCCCGTCTCCCGGNCCCCANNNCNATTAGGAA

CCACCNTCGCNGGNCTTGGNACCCATTTAGGGGTGGCCCTTCCGGNCGGC

TTCGGAAGGNCGNCGGTAGTTGTTGTTGCCNACCGTTAAGACGGTCTCCG

GGCGTCNCCNGGCTTCCCCGGNCCGGTTGGTTTGGGCCCCTAACACCGCC

GACTCCGGCCATTNCAAAGCCGCGCGCTCGGGCTTCCACGGGGCCCCNT
```

```
-continued
GCNANCTGGGCGTTGCGTTCTCGTTTCACGGGCGAGNAGGCTTGGCAAAA

AGACGAAGCCACTTTGTCCAAGGTCATGCAGTTGGTAAGTGGAAGCGCCC

CAAGCATTGNAACCCCAGGTCCCGGCCCCGCTTCCCGAAGCCCCGGCGTT

TCCCACCCCTTCCTTTGCCCGCTGCCCGCCTTCCTTGCGGGNAGGGGAGN

TTGNTCAAAAAGGGGCGTGTCGACAGGCAAGTTGGGNTCCAGGTTGGGCC

CGACCCACTAACCCGACTCGTTGCCCTGGGGCTTTACCCCCCCCNTTTC

CTTTTTGGNCTTTGGTTTCTCCNCNTGTGAAATGNAGGTAGTGCCAGCCG

TGCCTNCCTCAGAGGCGCGTGCGGAGCATCAGAGATCCATAGTGCATGTG

NAATTGCTCTGTAAATATCCCTGTGCGAAGNACATGGAAGGTGGTGCTTT

AAAGGATGGAAGGAGNCAGAGAGGGGCGGGGTGGGGAAGACTAGAGCAAT

CACAGAGGAAGGACGAACATGAGTGGGTGTTCTTGAAAGACCCCACNATN

GGTTTTCNAAGCAANGGG (SEQ ID NO: 428)
12-d11-Laco.Seq LENGTH: 1159 Mon, Jan. 31, 2000
2:51 PM CHECK: 6877 .., 992 bases, 15A5 checksum.
ATTACNCTTTNNACAAGGCCNGGACGAGACTCAGTGGATTCTGGGAATCA

TGGCCTTTGTGTCACAGAAGATGCCCTGNCAGGCGCCTTCAGGGGGTGTT

NNGGGGATGGGGGCACNGCGGTCACAGGGTCACTGTTAAGGAAGTTGGA

GCTGGATGGGAATCCAGCTGATTCTGNCCCTCCCTGCTCTGGGAAAGTGC

TCTGCCGCAAATGTCTTCCTTGCCTCACTCCCTATGTGCCTATNNCACCA

AGGNTGTNACCAAAAGGAGCTNGGGGTATTTTAGAGCTGATGGGGAACTT

CTACTTTCTTGNAAGGGCAAAGAATANTCGNTCGNTGTGCCCCACCTGCT

TNAGATCTAGGAGGAAAATCTGGGNANCTCCNGNNTTTGGGGCCCTNNGC

TCACACAAATGCCAACTTCTGGTCCCCACCCNACGGGTGATTTAGGCCAN

TTACTTAGATCCACGTTAATGAAGTTTTTCTGTTGCCTAAATTAGTTCAC

AGGGAACTNAGCCTTGGGAAGAAAAANAANCTAAGAGGATTTGNTGAAAG

GACACAAGGAAGTTATGTNNGGNATGTTTCAAGANCAAGGGCANGNACTT

TAGGGTTCAAANNGGGGGTTTTTTACTCCCATCCCAAAAATACTGGAATG

GNTTCTTTNCCCAGGTTGNAGGGGACCCTCCCAAAAGCATAAAAAGGGGG

GGTGTTTTAGNGTTGAAAAAAGGCCCCCAAAAGCNCTNACANCCAATAAT

GGGGGAATNTGACCCCTTAAATTGTNAANGGCCCCAANAAAATGGGGNC

NGGGCCCTTNNNCCCAAAATTCAATGNTNNTTNNCCCCNNNNNNAAAAAA

ANTTNAANGNNCCCCTTTTAAANAAATNTNTTNNNGGNCTNNNNANANGT
```

Additional Properties of Genes Necessary for Viral Infection

Table 1 provides a list of all sequences obtained utilizing the methods of the present invention. This table provides, from left to right, the Lab Designation, the gene comprising the Lab Designation sequence, human chromosomal location (if available) and any matches found in three publicly available databases (BLAST nr, est, and hgts). The database matches appear in the three columns immediately following the chromosomal location designation. Table 2 provides Lab Designations and additional information for a number of the clones isolated utilizing the methods of the present invention. Further description of the identified genes is provided following Table 2.

TABLE 1

| | | | | | |
|---|---|---|---|---|---|
| 06_RA2#E_rE.txt | gi|17456622| | 8q11.1 | 0.23 | 0.20 | 0.0 AC090206.3 h |
| 10_2A_3_12-rE.txt | gata4 | 8p23.1-p22 | 0.58 | none | 9e-28 AC099091.2 r |
| 10_3A_2_Lac.txt | PPM1A | 14q23.1 | 0.057 | 2e-4 AA089094 | 9e-91 AC107409.2| |
| 10_3b(5-2-96)_rE.txt | na | | H | none | H |
| 10_3bE_rE.txt | hp1-bp74[EIF4G3] | 1p36.12 | 5e-05 AL138784 | 7e-07 AW533300 | 6e-05 AL606477 |
| 10_3b_2_rE.txt | KLHL6 | 3q27.3 | H | 8e-10 AW915888 | H |
| 10_4A_8_rE.txt | gas5 | 1q23.3 | 1e-07 BC004622 | 8e-08 BI303289 | 0.41 |
| 10_4b_4_rE.txt | KLHL6 | 3q27.3 | h | 2e-69 AW915888 | 0.018 AC069211.12| |
| 11X#17_Lac.txt | na | na | 6e-05 satellite S64630 | 0.17 | 7e-08 AC107099.2| |
| 12C#A_rE.txt | LOC159772 | 11p15.3 | 0.51 | 4e-04 BF849608 | 2e-04 AC084304 |
| 12CX#11E_rE.txt | LOC168349–[LOC168348+] | 7q33 | 7e-30 AC024913.32| | 1.31 | H |
| 12CX#6_rE.txt | zfp-36 | na | 2e-11 AK018350 | 3e-36 BF548520 | e-178 |
| 12CXY#7_Lac.txt | prss11 | 10q25.3-q26.2 | 2e-17 satellite | 5e-11 repetitive 0.0 | AC110392.2/AC087063.17 |
| 12CXY#7_rE.txt | prss11 | 10q25.3-q26.2 | H | none | 7e-13 AC087063.16| |
| 12C_2B#9B-B4.txt | na | na | 2e-20 | none | H |
| 12C_2B#9E_rE.txt | LOC160198 | 11q24.1 | 2e-20 | 1e-20 BI105708 | 2e-20 AC016859 |
| 12PSA#6_rE.txt | EIF3S10 | 10q26 | 9e-47 MMU14172 | 8e-53 AI597159 | 1e-30 AC026587 |
| 12_3B#10-rE.txt | LOC164360 | 20p11.22 | H | 0.18 | 0.0 AC114195.1| |
| 12_3B#10_Lac.txt | na | h | 1e-20 H32702 | 0.0 AC114195.1| | H |
| 12_3B#2_Lac.txt | jwa [UBE1C+] | 3p14 | 0.23 | 0.18 | e-123 AC109665.2| |
| 12_3B#2_rE.txt | GTRAP3-18-art6 (jwa) | 3p14 | 5e-58 AF240182 | 2e-53 BF543062 | e-111 AC102724.1| |
| 12_3B#7_Lac.txt | DKFZP727C091 | 17q21.31 | 8e-68 S82811 | 2e-40 BE122674 | 1e-85 AC095637.3| |
| 12_3B#8_rE.txt | Aptx | 9p13.3.14 | 3e-8 AAA871174 | H | 0.0 AC114195.1| |
| 12_4b#11_rE.txt | na | na | 0.13 | na | 0.15 |
| 12_4B#7_rE.txt | LOC13854 | 9q31.3 | 5e-73 AL389915 hu | none | e-102 AC073037 hu |
| 12_4b(#11)-Lac.txt | DKFZP727C091 | 17q21.31 | 8e-68 | 2e-40 | 1e-85 AC095637.3| |
| 12_4b_9_lac.txt | YWHAE and loc14697 | 17q21.32 | 0.20 | 0.75 | 7e-14 AC102099.1| |
| 12_4b_9_re.txt | | | 0.037 | .031 | .042 |
| 12_6B#6_Lac.txt | LOC148582 | 1p31.2 | 0.066 | 0.053 | 4e-13 AL669966.4| |
| 12_6B#6_rE.txt | LOC148582 | 1p31.2 | 0.073 | 0.059 | 0.002 AL669966.5| |
| 12_I24_5_3-Lac.txt | HCK and KIAA0255 | +20q11–q12 | e-128 AC078911 | 0.20 | 0.001 |
| 14A13E_rE.txt | gata4 | 8p23.1 | 0.034 | 1.31 | 2e-47 AC099091.2| |
| 14A14E_rE.txt | | | H | none | H |
| 14A7re | smad7 | 18q21.1 | 3e-30 NM_030858.1| | 2e-37 AI556846 | 8e-25 ACO24384.4 h |
| 14C_2E_rE.txt | srp19 | 5q21-q22 | 6e-19 ACO91750 | 2e-12 BA395473 | 2E-78 ACO99430.2 |
| 14G3E_rE.txt | | | H | none | H |
| 14H1E_rE.txt | | | H | 1.31 | H |
| 14H4Erepeatmasker_rE.txt | repeat | | 1e-04 | 0.031 | 5e-08 |
| 14H4E_rE.txt | repeats | | 1e-09 | 3e-09 | 3e-16 |
| 14XD#12E_rE.txt | CLR-B | | 4e-49 AF320597 | 0.17 | 5e-06 AC117852.1 |
| 14XD#12E_T7.txt | | | 1e-83 AF320597 | 8e-16 | 1e-24 |
| 14XD#18B_B4.txt | | | H | 1.31 | H |
| 14_24_#6_Lac.txt | LOC94765 [fertl3–] | 10q23.32 | 4e-06 | 1e-05 | e-167 AC1054673 |
| 14_7#2E_rE.txt | mgat1 | 5q35 | 2e-69 abo12876 | na | 0.0 BF392858 |

TABLE 1-continued

| | | | | | |
|---|---|---|---|---|---|
| 17_3__3B_B4.txt | | | H | 0.70 | H |
| 17_3__3E-rE.txt | | | H | none | H |
| 17_3__3Ea-E.txt | | | H | none | 1.31 |
| 17_3__3E_rE.txt | | | H | none | H |
| 17_3__3He_1-T7. | | | 4e-06 ACO05667 | none | 2E-70 AL596111.7 |
| 17_3__3He_1_T3_rev.txt | LOC162407+/LOC162406 | fksg4- 17q23.3 | 0.23 | 1.31 | 0.29 |
| 17_3__3He_2-T7.txt | | | H | none | H |
| 18A_8_1E_rE.txt | loc158333 | 9p23 | 0.056 | 0.011 | 0.0 AC108575.2| |
| 18A_8_3E_rE.txt | | | 0.13 | 4e-63 BF409287 | 4e-42 AL645668 |
| 18A_8_4E_rE.txt | | | H | 0.0 bf409287 | 1e-89 AL645668 |
| 18_5#13E_rE.txt | | | H | na | 1.31 |
| 191E2E_rE.txt | CALD1 | 7q33 | 6e-05 | 0.049 | 3e-35 AC102668.1| |
| 191E8E_rE.txt | | | 0.059 | none | 0.29 |
| 191E9B_B4.txt | | | 0.004 | na | 0.003 |
| 191E9B_RB2_134.txt | MGC2663 | 19p13.2 | 1e-06 | 5e-05 BF561648 | 2e-11 AC073773 |
| 191E9E_rE.txt | | | 0.004 | 0.003 | 0.005 |
| 191E9E_rN80. | C lectin-related protein B | | 4e-43 AF320598S1 | na | 0.18 |
| 19D3E_rE.txt | 6PTHS | | 0.052 | 0.042 | 4e-37 AC113047.1| |
| 19D5E_rE.txt | DKFZP566D193 | 3q21-q22 | 1e-89 MM6PTPS1 | 1e-36 BF542916 | 0.0 AC094189.2| |
| 19_7AE_rE.txt | CTF2 | Xq21.33 | H | 0.49 | 5e-60 AC106523.1| |
| 19_9BE_rE.txt | RFP2 | 13q14 | 1.31 1e-74 | 1.31 1e-74 | AL671915.4| |
| 1A_A549_6_rE.txt | | | 0.0 AF279660 | 0.0 BI668033 | 0.21 |
| 1a_b4.txt | | | H | none | 0.17 |
| 1a_rE.txt | | | 5e-04 repeat | 0.090 | 6e-04 |
| 1bw_lac.txt | loc168348 | 7q33 | 1e-30 AC024913.32| | none | 0.32 |
| 20_L28AP-Lac.txt | LOC148904 | 1p36.11 | 0.41 | 0.33 | 1e-84 AL672076.2| |
| 21_5_7E(2)_Lac.txt | id3 1p36. | 13-p36.12 | 2e-20 repeat K00498.1|RATRSSIB | 2e-16 repeat |BE122674 | 2e-23 AC112345.1| |
| 21_5_7E_Lac.txt | | | 1e-24 K00498.1|RATRSSIB | 2e-20 BE122674 | 2e-27 AC095096.2| |
| 21_5_8E(2)_rE.txt | | | 2e-08 AL021154.1|HS15O5 | 1.31 | e-107 AC060772 |
| 21_5_8E_Lac.txt | | | 4e-06 AL021154.1|HS15O5 | 2e-04 AW917110 | 4e-56 AC060772 |
| 21_5_9E_Lac.txt | | | 0.003 AC108468.3| | 0.009 AI025166 | 0.004 AC113355.1| |
| 24_3_5#1_Lac.txt | | | 6e-11 AC068627.16| | 1e-11 BI302094 | e-102 AC098054.2| |
| 24_3_5#1_rE.txt | LOC162464 | 17q21.32 | 0.21 | 0.67 | 5e-46 AC069060.3| |
| 24_9_3#2-re.txt | C lectin-protein C | 8e-72 | AF320596 | 0.003 | na |
| 24_9_3#2_Lac.txt | 7e-17 satellite | | S64631 | 5e-08 | e-135 AC108952.2| |
| 24_A#1_rE.txt | TAC3 | 12q13-q21 | e-137 AC068609 | 2e-102 BG668235 | e-150 AC107006.2| |
| 29A_5_1_Lac.txt | s100a5 | | 5e-15 AF088189 | 9e-13 AA555734 | e-128 AC027648.10| |
| 2AE_lac.txt | | | 5e-38 satellite V01570.1|RNSAT1 | 9e-24 | 3e-40 |
| 2a_b4.txt | | | H | none | H |
| 2B2_T3.txt | | | none | H | 1e-68 |
| 2B2_T7.txt | | | e-163 vector | 4e-33 | 5e-69 AC116251.3| |
| 2b_b4.txt | | | 9e-58 repeat AC079437.2| | 6e-40 BF398164 | 3e-09 AC104088.5| |
| 2b_lac.txt | loc150800 | 2q31.1 | 0.034 | .028 | 0.66 |
| 2b_rE.txt | | | H | none | H |
| 3'est off1|4d#18|ac.txt | | | 7e-06 repeat AL683884.4| | 0.0 BF411674 | 3e-08 AL683884.4| |

TABLE 1-continued

| | | | | | |
|---|---|---|---|---|---|
| 31_3_15#1_Lac.txt | fkbp8 | 19p12 | 0.001 | 7e-4 AW935927 | 5e-86 AC068650 |
| 31_3_15#1_rE.txt | fkbp8 | 19p12 | 3e-34 repeat AC090529.2\| | 5e-36 AI715684 | 2e-36 AC096171.2\| |
| 31_3_17_Lac.txt | | | 4e-06 | 5e-05 | 1e-24 |
| 31_3_17_rE.txt | | | 4e-06 | 5e-05 | 2e-24 |
| 31_3_19#2_Lac.txt | | | 0.004 | 0.70 | e-161 |
| 31_3_19#2_rE.txt | | | 8e-72 | 6e-76 | |
| 31_3_19#2_rE.txt c lectin-related protein C | | | 0.016 | 0.013 | 8e-05 |
| 31_3_4_rE.txt | | | 9e-07 | 1e-54 | 0 |
| 31_3_5_rE.txt | znf207 | 17q11.2 | 1e-30 CNS00002 | 0.64 | 2e-82 AC107272.2\| |
| 31_3_6_2_Lac.txt | FKBP8 | | 3e-34 repeat AC090529.2\| | 6e-35 AI715684 | 1e-40 AC108331.2\| |
| 31_3_6_2_rE.txt | mail | 3q12.3 | 1e-92 030612.1\| | e-113 AA798638 | 0.0 AC111450.1\| |
| 31_3_9_rE.txt | | | H | none | none |
| 31_4_2_Lac.txt | | 22q12.2 | H | 6e-4 BF389250 | 1e-89 AC095192.2\| |
| 31_4_2_Laca.txt | | | H | none | H |
| 31_4_2_LacO.txt | | | 0.27 | none | 0.33 |
| 31_4_2_rE.txt | | | 4e-33 AK018434 | 0.0 AI482282 | 0.0 AL135899 |
| 31_4_4#1_Lac.txt | prss11 | 10q25.3-q26.2 | 6e-14 AL583887 | 3e-12 BB192448 | 3e-50 AC087063.17\| |
| 31_4_4#1_rE.txt | | 22q12.1 | 0.054 | 0.17 | 0.0 AC095192.2\| |
| 31_4_5#1_Lac.txt | | | 0.21 | 0.67 | 0.27 |
| 31_4_5#1_rE.txt | | | H | 0.73 | 0.0 AC105839.1\| |
| 32_3_2#1E-Lac.txt | | | H | 8e-13 AI021238 | 0.30 |
| 32_3_2#1E_rE.txt | | | 0.004 AC006027.2\| | .003\|BF509588 | 5.8 |
| 34X23_3_1-rE.txt | CAM2 | 7p15-p14 | 1e-91 AJ312410.1\|RNO312410 | none | 2e-91 AC094362.2\| |
| 34X23_3_1-rE.txt | card4 | 7q21.1 | 2e-20 AC000039 | 6e-14 BG717658 | 0.083 |
| 34X24_126-rE.txt | Abcb1b | 22q13.1 | 0.066 | 0.21 | 2e-08 AC094592.2\| |
| 34X25_23_Lac.txt | MAP3K7IP1 | 1p31.2-32.1 | 9e-17 AL109926.9\|HSDJ543C6 | .20 | 0.0 AC094592.2\| |
| 34X25_23_rE.txt | PDE4B | | 5e-40 repeat K00500.1\|RATRSSID | 1e-18 BE122674 | 3e-45 AC095096.3\| |
| 36_5_5a_rE.txt | | | 5e-05 AF267747 | 2e-04 BF950374 | 8e-23 AL663067.7\| |
| 36_5_2_19_4_rE.txt | | | 3e-4 AC098729.3\| | 8e-4 AI552849 | 2e-08 AC116254.1\| |
| 36_5_2_19a_LacO.txt | | | 2e-29 repeat AC091503.2\| | 1e-30 BI292332 | 2e-33 repeat AC099104.2\| |
| 36_5_2_19b_LacO.txt | | | 8e-10 repeat AL592303.15\| | 4e-04 AI552849 | 2e-13 AC094419.2\| |
| 36_5_2_6-rE.txt | brd2 | 6p21.3 | 4e-64 AF100958 | 5e-17 | e-135 AC098547.2\| |
| 36_5_2_6_LacO.txt | RD2 | | | e-126 AF100956 | 2e-29 BI653651 7e-21 AL671924.2\| |
| 36_7_1_a_rE.txt | | | H | none | H |
| 38_17#2_rE.txt | SCMH1 | 1p34 | 5e-12 AK009416 | 0.054 | 0.0 AC109561.2\| |
| 39_2_6-Lac.txt | | | 4e-92 | repeat AL645968.6\| | 8e-84 BI289726 |
| 39_2_6-rE-repMa.txt | | | H | none | none |
| 39_2_6-rE.txt | | | 6e-45 AL591207.15\| | 2e-38 repeat BI290754 | 3e-53 repeat AC097552.3\| |
| 3_2_13_rE.txt | s100A6 | 1q21 | 5e-12 repeat AC025910 | 8e-60 AA267952 | 2e-73 AC027648.11\| |
| 3_2_4_rE.txt | s100A6 negative strand | 1q21 | 5e-21 repeat in L47235.1\|MUSXPDG1 | 3e-13 BF566181 | 7e-55 AC027648.11\| |
| 3_6_9_teoG_rE.txt | | | 0.28 | none | 0.35 |

TABLE 1-continued

| | | | | |
|---|---|---|---|---|
| 42_8#3_rE.txt | arhgef3 | 3p21-p13 | 5e-49 AK016751 | e-49 BB642560 | 0.0 AC10871.2| |
| 49_RA2_A_rE.txt | hnrpl | 19q13.2 | 0.0 AC008982 | 4e-20|BG941347 | 4e-24 repeat AC069503.21| |
| 4ae5_rE.txt | ms4a48b | 11q13.1 | 0.047 | none | 0.0 AC097387.3| |
| 4a_b4.txt | | | 0.011 | 0.14 | 9e-04 |
| 4cx_b4.txt | | | H | none | H |
| 4c_lac.txt | | | H | none | |
| 4c_rE.txt | | | 0.002 | none | 0.14 |
| 5ad4-rE.txt | | | H | | H |
| 5ASE_Lac.txt | | | 3e-12 repeat AF260927 | 5e-10 BG071839 | 0.0 repeat AC110948.2| |
| 5a_b4.txt | | | H | none | H |
| 5a_lac.txt | | | 0.033 | 6e-15 BF396599 | 0.0 repeat AC112381.1| |
| 5a_rE.txt | | | H | none | H |
| 5_1_LacO.txt | LOC161391 | 14q24.3 | H | none | H |
| 5_1_LacO.txt | | | 5e-18 repeat AC112870.1| | 4e-21 BE650278 nonrepeat | 2e-21 |
| 6ae_T7.txt | | | 2e-24 RATSIB25I3 satellite | 8e-23 BE122674 | 1e-28 AC095863.2| |
| 6aso1_rE.txt | | | H | none | H |
| 6B37H_T7.txt | anx1 | 9q12-q21.2 | e-152 U25159.1|RNU25159 | 0.29 | 0.0 AC106671.1| |
| 6B52E_rE.txt | LOC94765 [fer1l3-] | 10q23.32 | 8e-04 | 0.011 | e-162 AC105467.3| |
| 6B52_Lac.txt | TPM1 | 15q22.1 | H | 5e-05 | 2e-05 |
| 6BE1_Lac.txt | | | 0.0 | 0.0 | 0.0 |
| 6BE1_rE.txt | | | 8e-75 RNPBUS19 | 1e-73 BE104253 | 0.0 AC107332.2| |
| 6BE3_lac.txt | | | 4e-18 repeat RNSAT1 | 1e-39 | e-126 AC098526.5| |
| 6be3_rE.txt | atp6c L or C | -16p13.3 | 4e-57 AF356008 | e-142 AI045498 | 0.67 |
| 6be5_rE.txt | BAB24609 FLJ23468 | 4q35.1 | 3e-31 AK006479 | 2e-31 BI107987 | 3e-22 AC117951.1| |
| 6BE60_rE.txt | tpm1 | 15q22.1 | e-106 M15473.1|RATTMA4 | 4e-98 BF523256 | e-141 AC095434.2|/humanAC079328.7| |
| 6BE65_T7.txt | abcr [likely PARG1] | 1p22.1-p21 | 4e-64 NM_007378.1| | 0.16 | 0.0 AC096978.3| and human AC105278.1| |
| 6BE72_Lac.txt | na | | H | none | 7e-05 AC080168 |
| 6BE72_rE.txt | CTCF | 16q21-q22.3 | 1e-05 BC009129 | 8e-22 AI071481 | none |
| 6bh15_T3.txt (188-end-vector)first 188 | 2e-60 tma3 | 15q22.1 | M16433.1|RATTMA3 | 1e-14 av681483 RATTMA3 | 4e-61 AC095434.2| |
| 6BSA#12_T3.txt | ADAM10 | 15q21.3-q2 | 2e-17 repeat | 1e-17 repeat AV681528 | 1e-09 repeat AC007412 |
| 6BSA12_B4.txt | na | | H | na | none H |
| 6BSA12_rE.txt | ADAM10 | 15q21.3-q2 | H | 0.72 | 3e-53 AC093406.1| |
| 6_3_6_2B_B4.txt | na | | H | none | H |
| 6_3_6_2E-rE.txt | loc169647 | 9q34.13 | 1e-08 022596.1| | 6e-32 BF556068 | 5e-83 AC068494.11| |
| 6_3_6_2E_Lac.txt | ANXA3 | 4q13-q22 | 2e-32 satellite S64624 | 2e-16 BE122674 | 1e-74 AC068494.11| |
| 70A-rE.txt | na | | H | none | 0.0 AC111410.1| |
| 7A10_1-Lac.txt | na | | 0.007 | 0.51 | 0.0 AC111410.1| |
| 7A10_1_rE.txt | protein | 3p24 | 2e-04 repeat RNU77636 | 2e-04 BI301327 | -09 AC112322.1| |
| 7A7_Lac.txt | anx12 | 15q21-q22 | 0.22 | 0.69 | 4e-31 AC073741 |
| 7A7_rE.txt LOC145817(ANXA2) overlap by FLJ11896 | | 15q21.3 | 3e-64 AC000399 | .026 BE892019 | 4e-05 AC019146 |
| | | | 2e-97 AC000399 | 0.045 | 0.072 |

TABLE 1-continued

| | | | | |
|---|---|---|---|---|
| 8C5_11-rE.txt | | | 1.31 | H |
| 8C5_11_Lac.txt | | H | none | H |
| 8C5_6-Lac.txt | | H | 0.16 | 0.0 AC097795.2| |
| 8C5_6_rE.txt | | H | 0.18 | 0.0 AC097795.2| |
| 9A#2_3_Lac.txt | NPEPPS | 17q21 | 13-15 AC025682_6| | H |
| 9A#2_3_rE.txt | na | na | none | 3e-69 AC094412.2| |
| 9B27_2_rE.txt | MGC20647 | 22q12.1 | 0.23 | na |
| B10_3b_2_3Lac.txt | hsjl[2] negative strand | 9p13-p12 | 2e-32 RNU53922 | 1e-30 BB606068 |
| L11#17_rE.txt | jwa negative stand | 3p14 | H | 2e-11 AC107815.1| |
| L11X#17_Lac.txt | na | | 1e-6 AL671916.4| | none |
| L12cx#11_Lac.txt | na | | 0.003 0.17 | e-162 AC107099.2| |
| L12cx#11_rE.txt | na | | H | H |
| L14D#18_Lac.txt | na | | 9e-30 | none |
| L14D#18_I_ac.txt | na | | 5e-18 | none |
| L14D#8_Lac.txt | na | | 0.016 | 1e-08 |
| L14XD#18_rE.txt | na | | H | 1e-15 |
| L14XD#18_rE.txt | na | | H | none |
| L14XD#2_Lac.txt | na | | H | H |
| L14XD#2_rE.txt | na | | H | H |
| L14XD#8_rE.txt | na | | 0.22 | 0.30 |
| L14XD12E_rN80.txt | na | | 2e-51 | 2e-05 |
| L14_7_2B_B2.txt | na | | 6e-11 | 2e-17 |
| L14_7_2B_B4.txt | na | | H | H |
| L1739E_rE.txt | na | | 0.22 | 0.070 |
| L191B2E#1_Lac.txt | na | | e-139 | 0.063 |
| L191B2E#1_RE.txt | rpa16 | 7p22 | e-117 | 0.0 |
| L191B2E#3+_rE.txt | na | | 9e-07 | H |
| L192A3E_Lac.txt | na | | none | 7e-04 |
| L192A3E_rE.txt | fertl3 | 6q26 | 0.20 | none |
| L192B3E#13_rE.txt | m6p/Igf2r | | 2e-60 | 0.62 |
| L193A1E#A_Lac.txt | na 3e-06 | | 3e-16 | 1e-55 |
| L193A1E#A_rE.txt | na | | e-157 | 4e-16 |
| L194o4E_rE.txt | na | | H | |
| L195B1E_Lac.txt | na | | H | 8e-08 |
| L195B1E_rE.txt | gtf2e1 | | 0.63 | e-132 |
| L195C5E-rE | CL2-like 1 | 20q11.21 | 3e-16 | 0.0 |
| L197B3E-rE | na | | 2e-11 | 3e-13 3e-13 |
| L197B3E-rf.txt | na | | H | 0.0 |
| L197B3E_Lac.txt | na | | 4e-06 | e-119 |
| L19D16E-rE | na | | 0.004 | e-146 |
| L21C1E_Lac.txt | na | | 3e-06 | 4e-37 |
| L21_5_7#2_Lac.txt | na | | H | na |
| L22_5A1_Lac.txt | na | | 3e-06 | 0.24 |
| L22_5A1_rE.txt | na | | 0.064 | </PRE> |
| L24_10_1BE_rE.txt | na | | 0.063 | </PRE> |
| L24_26_10-rE.txt | na | | H BF525273 | none |
| L24_26_10-rE.txt | loc168348 | | 0.19 | 0.31 |
| L24_26_1_B4.txt | na | | e-144 | 1e-11 |
| L24_26_1_BL-re.txt | na | | e-168 | e-134 |
| | | | H | none |
| | | | e-103 | 9e-48 |
| | | | | H |
| | | | | 0.27 |
| | | | | H |
| | | | | 3e-35 |
| | | | | 4e-24 |

TABLE 1-continued

| | | | | </PRE> | |
|---|---|---|---|---|---|
| L24_26_2A-rE.txt | na | | 0.22 | 0.27 | |
| L24_26_2B-Lac.txt | na | | e-164 | 7e-33 | |
| L24_26_2B-rE.txt | na | | e-178 | 8e-33 | |
| L24_3_2B_rE.txt | na | | 0.26 | none | |
| L24_4_2-Lac.txt | na | | 1e-05 | 0.054 | 0.32 |
| L24_4_2-rE.txt | na | | 0.066 | 0.052 | e-107 |
| L24_4_2AE_rE.txt | na | | 0.066 | 0.052 | |
| L24_4_2BE_rE.txt | dlx2 negative | 2q32 | 2e-23 | none | 0.0 |
| L24_4_3-Lac.txt | na | | e-170 | 2e-91 | 2e-92 |
| L24_4_3-rE.txt | kiaa0255 | | 4e-71 AC078911 | 3e-43 plasmid | e-167 |
| contamination AC006099 | | | | | 4e-47 plasmid |
| L24_5_2-Lac.txt | na | | 1e-37 | 1e-30 | 5e-40 |
| L24_5_2-rE.txt | na | | 0.26 | none | 0.33 |
| L24_5_2BE_rE.txt | HNF3B | 20p11 | 0.004 | 0.013 | 0.0 AC113866.2| |
| L24_5_2BE_rE.txt | kiaa0255- | | e-125 AC078911.11| | 3e-06 | 6e-06 |
| L24_5_3_rE.txt | KIAA0255- | 20q11.21 | e-125 AC078911.11| | na | 3e-06 6e-06 |
| L24_6_3-Lac.txt | na | | 0.067 | 0.22 | 0.0 |
| L24_9_1-Lac.txt | na | | 0.27 | none | 8e-67 |
| L24_9_1_rE.txt | s100a6 | | 9e-23 | 7e-23 | 1e-25 |
| L25_10-Lac.txt | TCEB3 | | 5e-21 | 2e-13 | e-110 |
| L28AP-rE.txt | | | 1p36.1 | 0.43 | 0.40e-102 |
| AL672076.2| | | | | | |
| RA2#C_Lac.txt | na | | 7e-66 | 0.0 | 0.0 |
| RA2#C_Lac.txt | na | | 0.0 | 4e-06 | 0.0 |
| RA2#C_rE.txt | na | | 0.069 | e-119 | 0.0 |
| RA3_A_rE.txt | dj3240 | 17.1.2 | 0.0 | 0.72 | |
| RA5_A_rE.txt | na | | 1e-51 | 0.17 | |
| RA5_B_rE.txt | gamma crystalline | | 0.0 | 0.003 | 0.0 |
| SCA6#1_Lac.txt | loc131020 | | 0.25 | e-102 BF289981 | 6e-64 AC103936.2| |
| SCA6#1_rE.txt | LOC151593 | 3q24 | H | 0.68 | 3e-44 AC103936.2| |
| SCA7#5-Lac.txt | na | | H | none | H |
| SCA7#5_rE.txt | na | | H | none | |
| SCA9#14_Lac.txt | na | | 6e-45 | 0.003 | |
| SCA9#14_rE.txt | 7e-23 | | 6e-20 | 5e-55 | 7e-05 |
| ScB2#19_Lac.txt | erbin | | 2e-07 | 4e-09 | |
| ScB2#19_rE.txt | ERBB2IP | 5q13.1 | H 1e-27 | H | |
| second est of Incyte for 6_3_6_ | na | 0.0 | na | 0.0 | 0.0 |
| seq1a_lac.txt | na 7e-80 | 3e-83 | | | |
| seq1b_lac.txt | znf7 (KOX4) | 8q24 | 0.46 | 0.092 | 0.14 |
| sequence match for 34X23_1.txt CAR (RFP2) | | 13q14 | 0.0 | na | 0.0 0.0 |
| X11_rE.txt | na | | e-178 | 8e-84 | 1e-18 |
| x13_rE.txt | na | | H | none | 4e-48 |
| x15_rE.txt | fksg28 | 10q24.2 | e-167 | e-121 | e-149 |
| x18 estAI647623.txt | kiaa1303 | 17q25.3 | 2e-10 | 2e-10 | 0.0 |
| X18H_t7.txt | kiaa1303 | | e-104 | e-103 | e-143 |
| X20_rE.txt | nicer element | | 0.018 | 0.23 | |
| X236E1_T3.txt | na | | 0.013 | none | e-116 |
| X236E1_T7.txt | na | | | | |

TABLE 1-continued

| | | | | | |
|---|---|---|---|---|---|
| X23_7-T3-clean.txt | na | | H | H | |
| X23_7_T3-intact.txt | na | | 4e-18 | 1e-11 | 0.001 |
| X23_7_T7.txt | na | | H | none | H |
| X23_8_T3.txt | na | | H </PRE> | 0.066 | |
| X24_4_T7.txt | na | | H | none | H |
| x27b4f_1.txt | na | | 0.38 | 0.48 | 0.16 |
| x2_b4.txt | na | | H | none | |
| X3_2_13_Lac.txt | s100a6 | | 5e-15 | 1e-12 | 2e-15 |
| X3_2_4_LacO.txts100a6-wrong direction | | | 7e-76 | 7e-60 | 6e-83 |
| X4_rE.txt | na | | H | 1.31 | H |
| x5_rE.txt | na | | H | none | 2e-34 AC110459.2 |
| X7B-B4.txt | na | | H | 1.31 | H |
| EST extensions or est match blasts results; | | | | | |
| 0542234 est of 14a13e_re.txt h | gata4 | 8p23.1-p22 | H | none | 8e-16 AC069185.6 |
| EST 10_3b_2_rE.txt | 2e-70 | | 0.0 | 1e-43 | |
| est 5ase-lacAA946172.txt | | | 0.002 | 5e-62 | 0.0 |
| est for 10_4b_4_rE.txt | | | 0.69 | 0.0 | H |
| est for scb2#19.txt | 2e-76 | | e-151 | 1e-53 | |
| est From 12 4b_9re.txt | | | 0.0 | 0.0 | 3e-48 |
| est from 12c#A-re-AA972262. | e-116 | | e-143 | 6e-86 | |
| est from 12_3B#8_RE.txt | APTX | 9p13.3 | 0.0 | aa871174 | 0.01 1e-07 |
| EST from L193A1E#A_rE-AI230550. | | | 3e-04 | 0.0 | 0.0 |
| est of 42_8#3_rE.txt | | | 0.0 | 0.0 | 5e-77 |
| est of 31_3_9_lac.txt | | | 0.0 | 0.0 | 0.0 |
| est of 32_3_2#1E_rE.txt | | | 0.10 | 0.33 | |
| est of 36_5_2_19b_lac.txt | | | 2e-44 | 0.0 | 1e-64 |
| est of 6_3_6_2E-rEa.txt | LOC169647 | 9q34.13 | 0.0 | 0.0 | e-166 |
| est of L195B1E-lac.txt | GTF2E1 | 3q21-q24 | 1e-08 | 0.0 | 0.0 |
| est of RA2#C_rE.txt | | | 0.34 | 0.0 | e-124 |
| est of sca6#1.txt | | | e-166 | e-106 BE089756 | |
| Est-31-3-9 lncyte1056987-1.txt | | | 2e-92 | | |
| est-36_5_2_196-rE AI552849.txt | | | na | 0.0 | 2e-63 |
| est-L24_5_3BE_rE.txt | id3 | | 1e-19 | 0.0 | 0.0 |
| est191e9b-rb2-124.txt | e-121 | | 2e-20 | 0.0 | 0.0 |
| EST224186 of x18.txt | TUSP | 6q25-q26 | e-149 | 2e-16 | 2e-23 |
| est_L24_5_3BE_rEa.txt | GTF2e1 | | 0.0 | 0.0 | 0.0 |
| extension of est-L195B1E_rE.txt | APTX | 9p13.3 | 6e-08 | 0.0 | 0.0 |
| gene of 12_3b#8.txt | na | | 0.0 | 0.0 | 0.003 |
| incyte cDNA for 24-26-10-human. | na | | 0.0 | e-170 | 1e-06 |
| incyte est of 6_3_6_2E-rFa est | | | e-160 | 0.0 | 5e-61 |

TABLE 2

| | SEQ_NAME | SEQ_NOTES |
|---|---|---|
| 1 | 10_2A_3_12-rE | GATA4: GATA binding protein 4 human chromosome 8 10,812K-12,275K |
| 2 | 10_3A_2_Lac | Ppm1a: protein phosphatase 1A, magnesium dependent, alpha isoform murine chromosome 12 67,344K-67,458K |
| 3 | 10_3bE gene-F113534 | Hp1bp3 heterochromatin protein 1 binding protein 3, 1p36.12 HP1-BP74 |
| 4 | 10_3b_2_rE | LOC239743 similar to kelch-like 6 (*Drosophila*) [*Homo sapiens*] murine chromosome 16 A3 |
| 6 | 10_46_4-Lac | aprataxin 5 prime of DnaJ Hsp40 homolog, subfamily A, member 1 |
| 7 | 10_4A_8_rE | gas5 murine chr 1 |
| 8 | 10_4b_4_rE | sits at end of LOC287974 in negative strand-positive strand-upstream maybeB3gnt5 1599 bp mRNA linear ROD 28-JAN-2003 DEFINITION *Rattus norvegicus* UDP-GlcNAc:betaGal beta-1, 3-N-acetylglucosaminyltransferase 5 (B3gnt5), mRNA. |
| 9 | 12C#A_rE | kiaa0750 human chr 11 |
| 10 | 12CX#11E_rE | LOC330280 or Psma3 is listed as being only 853 nts, which seems unlikely murine chromosome 6 |
| 11 | 14A7re | Madh7 MAD homolog 7 (*Drosophila*) at 18p12 human chr 18 46,230K-46,308K |
| 12 | 12CX#6_rE | *Rattus norvegicus* similar to gonadotropin inducible ovarian transcription factor 1 |
| 13 | 12CXY#7_rE | HTRA, PRSS11 murine chromosome 7 119,771K-119,793K, human chromosome 10q25.3-q26.2 |
| 14 | 12C_2B#9E_rE | LOC244819 murine chr 9 993161 . . . 1003851 + 99 20888725 |
| 15 | 12PSA#6_rE | ref: NP_003741.1 - eukaryotic translation initiation factor 3, subunit 10 (theta, 150/170 kD); eukaryotic murine chr 19 21363609 . . . 21370345 − 448 6753740 Eif3 eukaryotic translation initiation factor 3 |
| 16 | 12_3B#10-rE | LOC241690, mouse 5 of rin2 - which is likely gene mRNA complement(join(45074453 . . . 45074634, 45082032 . . . 45082055, 45083667 . . . 45083839, 45100942 . . . 45101235, 45140102 . . . 45140163)) LOC241690 /product = similar to ribosomal protein L10 [*Rattus norvegicus*] /transcript_id = XM_141402.1 |
| 17 | 12_3B#2_Lac | Arl6ip5 |
| 18 | 12_3B#2_rE | positive strand chr 4 rat is: ubiquitin-activating enzyme E1C Ube1c and on the other side, similar to Neuronal tropomodulin (N-Tmod) (Tropomodulin 2) LOC312585 negative strand.glutamate transporter EAAC1 interacting protein negative strand. |
| 19 | 12_3B#8_rE | aprataxin, murine chr 4 - this gene is off negative strand, and there may be another rat gene |
| 20 | 12_3B#7-rE | Peptidyl-prolyl cis-trans isomerase A (PPIase) (Rotamase) (Cyclophilin A) (Cyclosporin A-binding protein |
| 21 | 12_4b#11_rE | NT_039230. Mm3_39270_30 *Mus musculus* chromosome 3 genomic contig no gene identified in this murine sequence |
| 22 | 12_4b_9_rE | LOC211313 NT_039299.1|Mm5_39339_30 *Mus musculus* chromosome 5 genomic |
| 23 | 12_6B#6_rE | |
| 24 | 12_L24_5_3-Lac | murine chr 2 closest murine gene is 1723887 . . . 1724855 − 323 20340819 LOC241732 TSPY which is probably not the gene |
| 25 | 14A13E_rE | 0542234 est of 14a13e_re murine chr 14 52M-55M next to gata 4 |
| 26 | 14A14E_rE | |
| 27 | 14C_2E_rE | srp19 human chr 5 murine 18 |
| 28 | 14G3E_rE | |
| 29 | 14H1E_rE | |
| 30 | 14H4E_rE | |
| 31 | 14XD#12E_rE | CLR-B murine chromosome 6 |
| 32 | 14XD#18B_B4 | |
| 33 | 14_24_#6-rE | region of ferl13 human chr 10 |
| 34 | 14_7#2E_rE | Mm11_39560_30 *Mus musculus* chromosome 11 genomic, mgat-1 |
| 35 | 17_3_3He_1-T7 | murine chr 11 E130113K08Rik |
| 36 | 18A_8_1E_rE | 18992349 . . . 19034645 + 126 21312102 1110029A09Rik murine chr 4 |
| 37 | 18A_8_3E_rE | 1469944 . . . 1479193 − 91 20840505 E130102H24Rik murine chr 4 |
| 38 | 18_5#13E_rE | |
| 39 | | |
| 40 | 191E2E_rE | |
| 41 | 191E8E_rE | 22749957 . . . 22802881 − 337 20877992 LOC239186 closest match murine chr 14 |
| 42 | 191E9E_rN80 | CLR-C 4448981 . . . 4475825 + 202 28526608 LOC333160 this is C lectin-related protein C murine chr 9 |
| 43 | 19D3E_rE | 6982588 . . . 6999715 + 162 28523464 LOC333094 murine chr 6 |
| 44 | 19D5E_rE | Pts 6-pyruvoyl-tetrahydropterin synthase |
| 45 | 19_7AE_rE | |
| 46 | 19_9BE_rE | Cstf2: cleavage stimulation factor chr X mouse and man |
| 47 | 1a_rE | |
| 48 | 1bw_lac | LOC195700 closest gene murine chr 6 294812 . . . 337018 + 438 28523444 |
| 49 | 20_L28AP-Lac | loc279232 murine chr 4 |
| 50 | 21_5_8E(2)_rE | E2F-2, murine chr 4 5700649 . . . 5721013 + 444 28498372 LOC242705 |
| 51 | 24_3_5#1_rE | murine chr 11 similar to Collagen alpha1 closest known gene LOC217123 |
| 52 | 29A_5_1_Lac | s100a6 murine chr 3 lac sequence in s100a5 |
| 53 | 2AE_lac | JNK-binding protein JNKBP1 like murine chr 2 8031390 . . . 8107228 − 343 28484974 LOC241298 |
| 54 | 2b_lac | 2281090 . . . 2321346 + 162 28485837 LOC329423 murine chr 2 next to dlx1 and 2 |
| 55 | 31_3_15#1_Lac | murine chr 8 within gene 8031390 . . . 8107228 − 343 28484974 LOC241298 off negative strand and probably disrupts 5790690 . . . 5796087 + 356 6857787 Fkbp8 |
| 56 | 31_3_17_rE | cut-like 1 (cutl1) 6647971 . . . 6737110 − 1332 7106283 Cutl1 CCAAT displacement protein murine chr 5 |
| 57 | 31_3_19#2_rE | 4637984 . . . 4643986 + 208 16716407 Ocil-pending C lectin-related protein B murine chr 6 |
| 58 | 31_3_5_rE | murine chr 11 38818453 . . . 38830549 + 461 6756051 Zfp207 Zfp207 |
| 59 | 31_3_6_2_Lac | murine chr 12 is equivalent to hu 14 in non-repetitive part 7737091 . . . 7806367 + 128 20849473 LOC217541 similar to 3-phosphoglycerate dehydrogenase |
| 60 | 31_3_9_rE | 53077725 . . . 53087552 − 729 13447398 Mail-pending definite murine chr 16 |
| 61 | 31_4_2_rE | 7424 . . . 39696 − 679 28505866 2310047I15Rik murine chr 11 |
| 62 | 31_4_4#1_rE | 755214 . . . 804073 + 481 9625027 Prss11 murine chr 7 |
| 63 | 32_3_2#1E_rE | 21171379 . . . 21180079 − 149 6680832 Calm2 calmodulin 2 murine chr 17 |
| 64 | 34X23_1-rE | murine chr 12 closest gene is 9807175 . . . 9807651 + 159 20849986 LOC238153 |
| 65 | 34X23_3-rE | two genes in opposite orientations-probably share a promoter region 1999682 . . . 2066949 − 1277 6755046 Abcb1b ATP-binding cassette, sub-family B (MDR/TAP), member 1B 2067489 . . . 2075793 + 142 28501108 LOC330031 vector disrupts loc33031 murine chromosome 5 |

TABLE 2-continued

| | SEQ_NAME | SEQ_NOTES |
|---|---|---|
| 66 | 34X24_126-rE | 41543381 ... 41569827 + 503 28486603 2310012M03Rik Similar to mitogen-activated protein kinase kinase kinase 7 interacting protein 1 TAK1 murine chr 15 |
| 67 | 34X25_23_Lac | 2377737 ... 2727820 + 722 9790151 Pde4b phosphodiesterase 4B, cAMP specific murine chr 4 2377737 ... 2727820 + 722 9790151 Pde4b phosphodiesterase 4B, cAMP specific |
| 68 | 34X25_23_rE | murine chr 4 2377737 ... 2727820 + 722 9790151 Pde4b |
| 69 | 34x25_5a_rE | |
| 70 | 36_5_2_196-rE | |
| 71 | 36_5_2_6-rE | murine chr 17 LOC309624 |
| 72 | 36_7_1_a_rE | |
| 73 | 38_17#2_rE | 20744318 ... 20811497 + 665 22095027 Scmh1 sex comb on midleg homolog 1 murine chr 4 |
| 74 | 39_2_6-rE | |
| 75 | 4a_b4 | murine chr 5 |
| 76 | 3_2_13_rE | s100a6 murine chr 3 |
| 77 | 3_2_4_rE | s100a6 murine chr 3 |
| 78 | 42_8#3_rE | murine chr 14 657807 ... 709478 + 1499 28477705 4933409E02Rik which is retinoblastoma-associated protein RAP140 |
| 79 | 4ae5_rE | 19q13.13 |
| 80 | 4c_rE | |
| 81 | 4cx_b4 | murine chr 1 |
| 82 | 5_1_Lac0 | 32168807 ... 32227960 − 625 28521737 LOC238331 murine chr 12 there is a repeat, but not in the first part of the sequence that matches this |
| 83 | 5a_lac | two ests-perhaps on rat chr 4 gi|20423079|gb|BQ206614.1|BQ206614 gi|11381574|gb|BF396599.1|BF396599 |
| 84 | 6B37H_T7 | 10964157 ... 10975247 − 347 6754570 Anxa1 murine chr 19 |
| 85 | 6B52E_rE | 4257489 ... 4269990 − 151 28551828 E030042N20Rik 4330462 ... 4335374 + 190 20888893 1200008O12Rik murine chr 19 |
| 86 | 6BE1_Re | *R. norvegicus* mRNA (pBUS19) highly repetitive sequence of retroviral origin |
| 87 | 6BE3_lac | 697470 ... 702328 − 156 6753144 Atp6v0c murine chr 17 |
| 88 | 6BE60_rE | tpm1, murine chr. 9 |
| 89 | 6BE65_T7 | 8533246 ... 8538206 + 218 20875728 LOC242198 8546745 ... 8685908 + 2269 6671495 Abca4 murine chr 3 t7 sequence is in abca4 but collaborator could not find expression in rie-1 cells |
| 90 | 6BE72_rE | CTCF, chr 19-rat |
| 91 | 6BSA12_rE | adam10 and LIPH Gene map locus 15q21-q23 |
| 92 | 6_3_6_2E-rE | golgi matrix protein GM130 and Mnbk-Dyrk1A-binds to grb2 human gene is GG95 |
| 93 | 6be3_rE | chr 17 697470 ... 702328 − 156 6753144 Atp6v0c |
| 94 | 6be5_rE | 2849866 ... 2876267 + 411 20863400 LOC330758 murine chr 8 Similar to serine/threonine protein kinase TAO1 |
| 95 | 6bh15_T3 | 13360838 ... 13381657 − 285 13270471 Tpm1 tropomyosin 1, alpha murine chr 9 |
| 96 | 70A-rE | murine chr 5 anxa3 |
| 97 | 7A10_1_rE | LOC269872 *Mus musculus* chromosome 7 genomic contig, strain C57BL 6J − 618181 ... 664133 |
| 98 | 8C5_11_rE | |
| 99 | 8C5_6_rE | murine chr 11 8625545 ... 8698887 − 921 6679491 Psa puromycin-sensitive aminopeptidase |
| 100 | 9A#2_3_rE | LOC289895: similar to Emu1 protein rat 14 Emu1 is restricted to epithelial extracellular binding |
| 101 | 9B27_2_rE | murine chr 4 17656746 ... 17665179 − 277 27228977 Aptx apraxin sits at start of dnaj1a |
| 102 | L11#17_rE | |
| 103 | L12cx#11_rE | closest to 276400 ... 276777 − 126 28523321 LOC330280 in region of AAC12943 3037091 proteasome alpha7/C8 subunit [*Mus musculus*] |
| 104 | L14D#18_Lac | |
| 105 | L14D#8_Lac | murine chr 16 negative strand between these two genes 42060678 ... 42085522 + 206 21312810 4833409J19Rik RIKEN cDNA 4833409J19 42212422 ... 42245696 + 950 23956172 Ssg1-pending |
| 106 | L14XD#18_rE | Gtpat12 |
| 107 | L14XD#2-rE | |
| 108 | L14XD#8_rE | murine chr 16 |
| 109 | L14XD12E_rN80 | 4448981 ... 4475825 + 202 28526608 C lectin-related protein C LOC333160 murine chr 6 |
| 110 | L1739E_rE | R74726 murine chr 9 |
| 111 | L191B2E#1_Lac | 1224295 ... 1225537 + 134 6677791 Rpol-3 murine chr 5 |
| 112 | L191B2E#1_RE | |
| 113 | L191B2E#3+_rE | 64583664 ... 64585839 + 305 20343300 LOC239678 although this gene appears to be on the negative strand murine chr 15 closest postive strand gene is HOXC13 |
| 114 | L192A3E_rE | in between E030042N20Rik: RIKEN cDNA E030042N20 gene and 1200008O12Rik: RIKEN cDNA 1200008O12 gene murine chr 19 4257489 ... 4269990 − 151 28551828 E030042N20Rik fer-1 like protein 3 4330462 ... 4335374 + 190 20888893 1200008O12Rik |
| 115 | L192B3E#13_rE | 5058584 ... 5144689 − 2483 23956054 Igf2r murine chr 17 |
| 116 | L193A1E#A_rE | |
| 117 | L194c4E_rE | 34316683 ... 34341462 − 441 21312660 Gtf2e1 general transcription factor II E, polypeptide 1 (alpha subunit) murine chr 16 |
| 118 | L195B1E_rE | similar to E2IG2 murine chr 7 28480555 LOC244162 rat chr 1 LOC308858murine chr 7 |
| 119 | L197B3E-rE | 1287066 ... 1334911 − 234 6753170 Bc121 murine chr 2 |
| 120 | L19D16E-rE | 6982588 ... 6999715 + 162 28523506 LOC333094 murine chr 6 |
| 121 | L22_5A1_rE | murine chr 14 negative strand maybe similar to FSHD Region Gene 2 |
| 122 | L24_10_1BE_rE | loc276970 murine chr 11 Mm11_39561_30 |
| 123 | L24_26_10-rE | 276400 ... 276777 − 126 28523321 LOC330280 murine chr 6 |
| 124 | L24_26_1_BL-re | repeat shows up on this |
| 125 | L24_26_2A-rE | murine chr 14 7931639 ... 7932322 − 228 20881545 LOC212081 |
| 126 | L24_26_2B-rE | 36668143 ... 36676666 + 254 28524792 LOC332305 murine chr 18 |
| 127 | L24_4_2AE_rE | |
| 128 | L24_4_2BE_rE | 2175918 ... 2178442 + 256 6753644 Dlx1 distal-less homeobox 1 2190449 ... 2192321 − 333 6753646 Dlx2 distal-less homeobox 2 murine chr 2 |

TABLE 2-continued

| | SEQ_NAME | SEQ_NOTES |
|---|---|---|
| 129 | L24_4_3-rE | 12387618 . . . 12442029 + 1221 28500402 2810442I22Rik 12527560 . . . 12529296 + 579 7657112 Galnt4 UDP-N-acetyl-alpha-D-galactosamine:polypeptide N-acetylgalactosaminyltransferase 4 12544567 . . . 12544764 − 66 6679305 ??Phxr2 murine chr 10 |
| 130 | L24_5_2BE_rE | 47832456 . . . 47859226 + 295 20912679 LOC241708 murine chr 2 |
| 131 | L24_5_3BE_rE | 1570784 . . . 1576636 + 193 21704056 LOC228788 similar to chromosome 20 open reading frame 160 1623748 . . . 1650722 + 504 6754166 Hck hemopoietic cell kinase 1686886 . . . 1691690 + 265 28488150 LOC329539 1701920 . . . 1708331 + 139 19527062 AU045326 expressed sequence AU045326 1723887 . . . 1724855 − 323 20340819 LOC241732 murine chr 2 negative strand |
| 132 | L24_6_3-Lac | LOC304968 rat 13q23 similar to RIKEN cDNA 1700009P17 [*Mus musculus*] |
| 133 | L24_9_1-Lac | LOC230761 murine chr 4 |
| 134 | L24_9_1_rE | 12638955 . . . 12746974 − 450 28490830 Ddx10 Similar to DEAD/H murine chr 9 |
| 135 | L25_10-Lac | 26660256 . . . 26660811 + 90 25048430 S100a6 murine chr 3 |
| 136 | L28AP-rE | murine chr 4-missing the gene in between 8430427k15 and loc279232 |
| 137 | SCA6#1_rE | 5459137 . . . 5476774 − 425 28492548 LOC244982 murine chr 9 |
| 138 | SCA7#5-Lac | C lectin-related protein B |
| 139 | SCA9#14_rE | 12018184 . . . 12022411 − 161 16519535 Erbb2ip the erbb2ip is in the correct orientation for this vector insert, the vector resides next to this gene-12120524 . . . 12120802 + 93 28526912 LOC328330 in the wrong orientation murine chr 13 |
| 141 | X23_7_T7 | |
| 142 | X23_8-T3 | |
| 143 | X24_4_T7 | |
| 144 | seq1b_lac | murine chr 15 mgc6397, related to zinc finger 7 (human) |
| 145 | 7A7_rE | chr 9 anxa2 |
| 146 | est12c#A-re-AA972262 | |
| 147 | est42_8#3_rE | rap140 retinoblastoma-associated Mm14_39638_30 *Mus musculus* chromosome 14 genomic contig, strain C57BL/6 657807 . . . 709478 + 1499 28477705 4933409E02Rik similar to RETINOBLASTOMA-ASSOCIATED PROTEIN RAP140 |
| 148 | ESTL193A1E#A_rE-AI230550. | AI326792 and 1300010C19-RAGA (RAS-RELATED GTP-BINDING PROTEIN murine chr 4 |
| 150 | est32_3_2#1E_rE | murine chr 17 |
| 151 | est36_5_2_19b_lac | CCr4-NOT complex-transcription factor subunit murine chr 6 |
| 152 | estL195B1E-lac | chr 9 mouse next to loc244982 |
| 153 | extension_est-L195B1E_rE | anxa2 murine chr 9 |
| 154 | 7a7_rE | A230053O16Rik murine chromosome 2, human chr 20 maybe Bcl2l Unexpectedly, the smaller mRNA species (BCLXS) encodes a protein that inhibits the ability of BCL2 to enhance the survival of growth factor-deprived cells. In vivo, the smaller BCLX mRNA was expressed at high levels in cells that undergo a high rate of turnover, such as developing lymphocytes. murine chr 2 |
| 155 | 36_5_1_4_rE | |
| 156 | L195C5E-rE | 4637984 . . . 4643986 + 208 16716407 Ocil-pending C lectin-related protein B murine chr 6 |
| 157 | 24_9_3#2-re | |

Two of the sequences (Lab Designation 10_2A_3_12-rE (SEQ ID NO: 17)) and Lab Designation 14A13E_rE (SEQ ID NO: 114)) isolated utilizing the methods of the present invention comprise sequence encoding GATA-Binding Protein 4 and map to human gene map locus 8p23.1-p22.

The GATA-binding proteins are a group of structurally related transcription factors that control gene expression and differentiation in a variety of cell types. Members of this family of DNA-binding proteins recognize a consensus sequence known as the 'GATA' motif, which is an important cis-element in the promoters of many genes. Arceci et al. (1993) cloned the mouse GATA4 cDNA by screening a 6,5-day embryonic library with primers based on the conserved zinc finger domains. The 50-kD predicted protein contains 2 zinc fingers and, when expressed in cell culture, activated appropriate reporter constructs. GATA 4 is associated with apoptosis, however, it was not previously known to be associated with any virus or with infection.

Another sequence (Lab Designation 10_3A_2_lac (SEQ ID NO: 213)) comprises sequence encoding PROTEIN PHOSPHATASE MAGNESIUM-DEPENDENT, 1A, ALPHA ISOFORM; PPM1A and maps to chromosome 14. This protein is also known as PROTEIN PHOSPHATASE 2C, ALPHA ISOFORM; PP2CA PP2C-ALPHA. Related to 2AE JNK-binding protein JNKBP1 like murine chr 2 8031390 . . . 8107228-343 28484974 LOC241298.

PPM1A is a serine/threonine protein phosphatase that is essential for regulating cellular stress responses in eukaryotes. By screening a human teratocarcinoma cDNA library with rat Pp2c-alpha as the probe, Mann et al. (1992) cloned the human counterpart, PPM1A, which they called PP2C-alpha. The PPM1A cDNA encodes a predicted 382-amino acid peptide that shares 99.7% amino acid identity with rabbit Pp2c-alpha.

In a genetic screen to identify protein phosphatases that negatively regulate the p38 (600289) and JNK (see 601158) stress-activated MAPK cascades, Takekawa et al. (1998) obtained a PP2C-alpha cDNA, which they initially called MC4, that encodes a 324-amino acid peptide. The authors hypothesized that MC4 is an alternative splicing product of PP2C-alpha. The 2 proteins, which they termed PP2C-alpha-1 (382 amino acids) and PP2C-alpha-2 (324 amino acids), differ at the C terminus. Northern blot analysis detected 2.8- and 4,4-kb transcripts, which correspond to PP2C-alpha-1 and PP2C-alpha-2, respectively. Both transcripts were expressed at high levels in heart, placenta, skeletal muscle, and pancreas, and the 4,4-kb transcript (PP2C-alpha-2) was detected in brain.

Using immunohistochemical analysis, Das et al. (1996) detected PPM1A in both the cytoplasm and nucleus of mammalian cells, consistent with a role in dephosphorylating components of stress-activated pathways.

By expressing PPM1A in mammalian cells, Takekawa et al. (1998) demonstrated that PPM1A inhibits the activation of the stress-responsive p38 and JNK MAPK cascades. Their in vivo and in vitro observations indicated that PPM1A dephosphorylates and inactivates MAPKKs (MKK6 (601254) and SEK1 (601335)) and a MAPK (p38) in the stress-responsive MAPK cascades. Using coimmunoprecipitation assays, the authors demonstrated that PPM1A directly interacts with p38. MAPK (mitogen-activated protein kinase) cascades are common eukaryotic signaling modules that consist of a MAPK, a MAPK kinase (MAPKK) and a MAPKK kinase (MAPKKK) (Takekawa et al., 2Calpha inhibits the human stress-responsive p38 and JNK MAPK pathways EMBO J. 1998 Aug. 17; 17(16):4744-520) Because phosphorylation is essential for the activation of both MAPKKs and MAPKs, protein phosphatases are likely to be important regulators of signaling through MAPK cascades. To identify protein phosphatases that negatively regulate the stress-responsive p38 and JNK MAPK cascades, we screened human cDNA libraries for genes that down-regulated the yeast HOG1 MAPK pathway, which shares similarities with the p38 and JNK pathways, using a hyperactivating yeast mutant. In this screen, the human protein phosphatase type 2Calpha (PP2Calpha) was found to negatively regulate the HOG1 pathway in yeast. Moreover, when expressed in mammalian cells, PP2Calpha inhibited the activation of the p38 and JNK cascades induced by environmental stresses. Both in vivo and in vitro observations indicated that PP2Calpha dephosphorylated and inactivated MAPKKs (MKK6 and SEK1) and a MAPK (p38) in the stress-responsive MAPK cascades. Furthermore, a direct interaction of PP2Calpha and p38 was demonstrated by a co-immunoprecipitation assay. This interaction was observed only when cells were stimulated with stresses or when a catalytically inactive PP2Calpha mutant was used, suggesting that only the phosphorylated form of p38 interacts with PP2Calpha.

Das et al. (1996) determined the crystal structure of PPM1A, which they called PP2C. The structure revealed a novel protein fold with a catalytic domain composed of a central beta sandwich that binds 2 manganese ions, which is surrounded by alpha helices. The authors stated that the protein architecture and deduced catalytic mechanism are similar to the PP1, PP2A, and PP2B family of protein ser/thr phosphatases.

Ofek et al. (Cell Cycle Regulation and p53 Activation by Protein Phosphatase 2Calpha, J Biol Chem 2003 Apr. 18; 278(16):14299-305) note that protein phosphatase 2C (PP2C) dephosphorylates a broad range of substrates, regulating stress response and growth-related pathways in both prokaryotes and eukaryotes. They demonstrate that PP2Calpha, a major mammalian isoform, inhibits cell growth and activates the p53 pathway. In 293 cell clones, in which PP2Calpha expression is regulated by a tetracycline-inducible promoter, PP2Calpha overexpression led to G(2)/M cell cycle arrest and apoptosis. Furthermore, PP2Calpha induced the expression of endogenous p53 and the p53-responsive gene p21. Activation of the p53 pathway by PP2Calpha took place both in cells harboring endogenous p53, as well as in p53-null cells transfected with exogenous p53. Induction of PP2Calpha resulted in an increase in the overall levels of p53 protein as well as an augmentation of p53 transcription activity. The dephosphorylation activity of PP2Calpha is essential to the described phenomena, as none of these effects was detected when an enzymatically inactive PP2Calpha mutant was overexpressed. p53 plays an important role in PP2Calpha-directed cell cycle arrest and apoptosis because perturbation of p53 expression in human 293 cells by human papillomavirus E6 led to a significant increase in cell survival. The role of PP2Calpha in p53 activation is discussed.

Another sequence (Lab Designation 10_3bE_rE (SEQ ID NO: 15)) comprises sequence encoding EUKARYOTIC TRANSLATION INITIATION FACTOR 4-GAMMA, 3 (EIF4G3).

Mammalian eukaryotic translation initiation factor 4G (eIF4G) is a scaffolding polypeptide that appears to be responsible for recruiting the 43S preinitiation complex to the mRNA through interactions with eIF4E (133440), eIF4A (see 602641), eIF3 (see 602039), and 40S ribosomes. See eIF4GI (600495). Gradi et al. (1998) identified a partial human cDNA encoding a protein with homology to human and rabbit eIF4GI. By screening additional libraries, the authors isolated cDNAs corresponding to the complete coding region of the novel protein, which they designated eIF4GII. The predicted 1,585-amino acid eIF4GI protein is 46% identical to eIF4G1. On Western blots, both eIF4G proteins migrated at approximately 220 kD. Using an in vitro assay, Gradi et al. (1998) showed that eIF4GII, like eIF4GI, was cleaved by the picornavirus rhinovirus 2A(pro). Far Western analysis and coimmunoprecipitation experiments demonstrated that eIF4GII directly interacts with eIF4E, eIF4A, and eIF3. eIF4GII restored cap-dependent translation in a reticulocyte lysate that had been pretreated with rhinovirus 2A(pro) to cleave endogenous eIF4G, leading the authors to conclude that eIF4GII is a functional homolog of eIF4GI. Northern blot analysis revealed that eIF4GII is expressed ubiquitously as 5.2-kb and 6,0-kb mRNAs. Imataka et al. (1998) demonstrated that the N-terminal regions of both eIF4GI and eIF4GII bind to PABP (604679). EIF4G is associated with poliovirus (Irurzun et al.).

Other sequences (Lab Designation 10_4b_4-rE (SEQ ID NO: 7)) and 10_3b_2-rE (SEQ ID NO: 13)) comprise sequence encoding KLHL6 protein and these sequences map to chromosome 3q27.3. This protein has the same domains as the gata4 protein described above.

Another sequence (Lab Designation 10_4A_8_rE (SEQ ID NO: 3)) comprises sequence encoding the gas 5 protein and this sequence maps to chromosomal location 1q23.3. The murine gas5 gene was originally isolated based on its preferential expression in the growth arrest phase of the cell cycle (Barone et al.) This gene contains 12 exons from which two alternatively spliced transcripts have been initially identified. More recently, it has been reported that both human and murine gas5 genes contain in their introns sequences homologous to the small nucleolar RNAs involved in the processing of ribosomal RNA. Here we report on the identification and analysis of the expression pattern of two novel alternatively spliced mouse gas5 mRNAs which contain no obvious open reading frame (ORF). Using antibodies generated against the putative amino acid sequence deduced from the gas5 cDNAs, we were not able to detect any Gas5 protein in cultured cells or murine tissues extracts. Even more definitive evidence that the gas5 gene may not encode a protein was obtained by cloning and sequencing the rat gas5 gene which revealed that the putative ORF is interrupted by a stop codon after the first 13 amino acids, correspondint or corresponds to the W region located between genes F9L and A38L. Within the terminal 13 kbp, colinearity is disrupted and multiple poxvirus gene homologues are absent or share a lower percentage of amino acid identity. Most of these differences involve genes and gene families with likely functions involving viral virulence and host range. Three open reading frames (SPV018, SPV019. and SPV020) are unique for SWPV. Phylogenetic analysis, genome organization, and amino acid identity indicate that SWPV is most closely related to the capripoxvirus lumpy skin disease virus, followed by the yatapoxvirus yaba-like disease virus and the leporipoxviruses. The gene complement of SWPV better defines Suipoxvirus within the Chordopoxyirinae subfamily and provides a basis for future genetic comparisons Another sequence (Lab Designation 12CX#6_rE (SEQ ID NO: 50)) comprises sequence encoding zfp-36. Zfp-36, the gene encoding the putative zinc finger protein tristetraprolin (TTP), is rapidly induced in fibroblasts by a variety of growth factors. Recent gene knockout experiments have shown that TTP-deficient mice developed arthritis, cachexia, and autoimmunity, all apparently mediated by an excess of tumor necrosis factor alpha. Lai et al. showed that full serum inducibility of Zfp-36 requires elements in the promoter; in addition, removal of the single intron strikingly inhibited serum-induced TTP expression. Lai et al also showed that replacement of the intron with unrelated sequences, or removal of 95% of the intron but retention of the splice sites, each resulted in the maintenance of approximately 45 and 19%, respectively, of full serum-induced expression. In addition, deletion of intron sequences base pairs 601-655 decreased the serum-induced expression of TTP by 65%. Sequence base pairs 618-626 bound specifically to the transcription factor Sp1; mutation of this binding motif decreased TTP expression by 70%, suggesting that Sp1 binding to this motif contributes to serum induction of Zfp-36 (Lai et al.).

Another sequence (Lab Designation 12CXY#7_rE (SEQ ID NO: 62)) comprises sequence encoding PROTEASE, SERINE, 11 or PRSS11. This protein is also known as HTRA; HOMOLOG OF *E. COLI* HTRA; HTRA; HTRA1 and maps to chromosomal location 10q25.3-q26.2.

Insulin-like growth factors (IGFs; see 147440) stimulate the proliferation and differentiation of a vast number of cell types. The action of the growth factors is mediated and controlled by a complex system of components, including at least 2 different forms of IGF, 2 IGF receptors (e.g., 147370), 7 different IGF-binding proteins (IGFBPs; see 146730), and several proteases that cleave the IGFBPs.

Zumbrunn and Trueb (1996) cloned the cDNA for a human protein, termed L56 by them, that seemed to be part of the IGF signaling system. The predicted protein encodes a 480-amino acid polypeptide with a molecular mass of 51 kD. Zumbrunn and Trueb (1996) found that PRSS11 contains a secretory signal sequence, an IGFBP-binding domain, and a serine protease domain. The serine protease domain is most similar to certain bacterial serine proteases. By Northern blot analysis, Zumbrunn and Trueb (1996) showed that PRSS11 is expressed in a variety of human tissues, with strongest expression in placenta.

Hu et al. (1998) also cloned PRSS11. The deduced 480-amino acid protein is 98% identical to the cow, guinea pig, and rabbit proteins. It contains an N terminus homologous to MAC25 (IGFBP7; 602867) with a conserved Kazal-type serine protease inhibitor motif, as well as a C-terminal PDZ domain. Semiquantitative RT-PCR and immunoblot analyses showed an approximately 7-fold increase of PRSS11 in osteoarthritis cartilage compared with controls. Functional and mutational analyses indicated that PRS11 is a serine protease dependent on the presence of a serine at position 328.

Using fluorescence in situ hybridization, Zumbrunn and Trueb (1997) mapped the PRSS11 gene to 10q25.3-q26.2.

Another sequence (Lab Designation 12PSA#6-rE (SEQ ID NO: 4)) comprises sequence encoding EUKARYOTIC TRANSLATION INITIATION FACTOR 3 THETA. This protein is also known as EIF3-THETA EIF3, p180 SUBUNIT, EIF3, p170 SUBUNIT, CYTOPLASMIC PROTEIN p167, MOUSE HOMOLOG OF CENTROSOMIN B. This sequence maps to chromosomal location 10q26.

Eukaryotic translation initiation factors (EIFs) initiate protein synthesis from mRNAs. EIF3, at 650 kD, is the largest of the EIFs. According to Johnson et al. (1997), EIF3 has been implicated in several roles, including binding to the 40S ribosomal subunit and to other EIFs, possibly to align the factors for initial binding to the 40S subunit and the subsequent identification of the AUG initiation codon. The EIF3 protein synthesis initiation factor is composed of at least 8 subunits, the largest of which is p180.

Another sequence (Lab Designation 12_3B#2_Lac (SEQ ID NO: 218)) comprises sequence encoding UBIQUITIN-ACTIVATING ENZYME E1C or UBE1C. This protein is also known as S. CEREVISIAE, HOMOLOG OF UBIQUITIN-ACTIVATING ENZYME 3, UBA3. This sequence maps to human chromosomal location 3p14.

Ubiquitin (191320) is covalently attached to target proteins by a multienzymatic system consisting of E1 (ubiquitin-activating), E2 (ubiquitin-conjugating), and E3 (ubiquitin-ligating) enzymes. Osaka et al. (1998) found that NEDD8 (603171), a ubiquitin-like protein, is conjugated to proteins in a manner analogous to ubiquitinylation. They found that APP-BP1 (beta-amyloid precursor protein-binding protein-1) can bind to NEDD8 in rabbit reticulocyte lysates. However, since APP-BP1 shows similarity to only the N-terminal domain of an E1 enzyme, the authors reasoned that it must interact with a protein showing similarity to the C-terminal region of E1s. By searching sequence databases, Osaka et al. (1998) identified cDNAs encoding UBA3, the human homolog of yeast Uba3. The predicted 442-amino acid UBA3 protein shares 43% sequence identity with yeast Uba3. In vitro, UBA3 formed a complex with APP-BP1 and a thioester linkage with NEDD8. Osaka et al. (1998) suggested that the APP-BP1/UBA3 complex functions as an E1-like enzyme for the activation of NEDD8.

Another sequence (Lab Designation 12_4B#7_rE (SEQ ID NO: 21)) comprises sequence encoding PEPTIDYL-PROLYL CIS-TRANS ISOMERASE A (PPIASE) also known as ROTAMASE, CYCLOPHILIN A or CYCLOSPORIN A-BINDING PROTEIN. This protein maps to chromosomal location 9q31.3.

A protein designated chickpea cyclophilin-like antifungal protein (CLAP) was isolated from seeds of the chickpea (*Cicer arietinum*). Chickpea CLAP was characterized by a molecular weight of 18 kDa and an N-terminal sequence homologous to cyclophilins. The protein was isolated with a procedure involving affinity chromatography on Affi-gel blue gel and ion exchange chromatography on CM-Sepharose. In addition to an inhibitory effect on the growth of fungi including *Rhizoctonia solani, Mycosphaerella arachidicola* and *Botrytis cinerea*, the protein was capable of inhibiting human immunodeficiency virus-1 reverse transcriptase. Chickpea CLAP did not possess lectin and ribonuclease activities but it weakly inhibited translation in a rabbit reticulocyte lysate system. The protein stimulated 3H-thymidine incorporation by mouse splenocytes.

Cyclophilin A is the target of the immunosuppressant cyclosporin A (CsA) and is encoded by a single unique gene conserved from yeast to humans. In the pathogenic fungus *Cryptococcus neoformans*, two homologous linked genes, CPA1 and CPA2, were found to encode two conserved cyclophilin A proteins. In contrast to *Saccharomyces cerevisiae*, in which cyclophilin A mutations confer CsA resistance but few other phenotypes, cyclophilin A mutations conferred dramatic phenotypes in *C. neoformans*. The Cpa1 and Cpa2 cyclophilin A proteins play a shared role in cell growth, mating, virulence and CsA toxicity. The Cpa1 and Cpa2 proteins also have divergent functions. Cpa1 mutants are inviable at 39 degrees C. and attenuated for virulence, whereas Cpa2 mutants are viable at 39 degrees C. and fully virulent. Cpa1 Cpa2 double mutants exhibited synthetic defects in growth and virulence. Cyclophilin A active site mutants restored growth of Cpa1 Cpa2 mutants at ambient but not at higher temperatures, suggesting that the prolyl isomerase activity of cyclophilin A has an in vivo function.

Another sequence (Lab Designation 12_L24_5_3-Lac (SEQ ID NO: 283) comprises sequence encoding HEMOPOIETIC CELL KINASE also known as HCK and KIAA0255. This sequence maps to gene map locus 20q11-q12. This gene was also disrupted off the negative strand in this region and disrupts an unknown gene.

During a search for a cDNA clone representing human SRC (190090), Quintrell et al. (1987) encountered a previously unrecognized gene that appeared to encode a protein-tyrosine kinase similar to SRC. Ziegler et al. (1987) found the same gene by a different route. Expression of this gene may be limited to certain hemopoietic cells and is especially prominent in cells of myeloid lineage, particularly mature granulocytes and monocytes. Therefore, Quintrell et al. (1987) designated the gene HCK (pronounced 'hick') for hemopoietic cell kinase. They described the nucleotide sequence of a cDNA clone that represents most or all of the mRNA for HCK, the deduced amino acid sequence of the protein encoded by HCK, and the distribution of RNA transcribed from HCK among various hemopoietic cells. By spot-blot analysis of sorted chromosomes and by in situ hybridization, Quintrell et al. (1987) assigned the HCK gene to 20q11-q12. Since this region is affected by interstitial deletions in some acute myeloid leukemias and myeloproliferative disorders, they suggested that damage to HCK may contribute to the pathogenesis of these conditions.

Another sequence (Lab Designation L24_5_2BE-rE (SEQ ID NO: 208) comprises sequence encoding HEPATOCYTE NUCLEAR FACTOR 3-BETA (HNF3B) (Kaestner et al.). This sequence maps to gene map locus 20p11.

Deleuze et al. (1994) investigated hepatic nuclear factor-3-beta as a candidate gene for Alagille syndrome (AGS; 118450) because of its pattern of expression during embryogenesis in derivatives of the embryonic gut and because of its localization to mouse chromosome 2 (Avraham et al., 1992) in the region syntenic with human chromosome 20 where AGS is located. They found that the gene was not deleted in a deletion case of AGS. The presence of the HNF3B gene in the deleted cells was established by Southern blot hybridization rather than by fluorescence in situ hybridization; hence, the assignment of the human gene to chromosome 20 was based on homology only.

Mincheva et al. (1997) used fluorescence in situ hybridization to map the HNF3B gene to human chromosome 20p11.

Another sequence comprises sequence encoding *DROSOPHILA* HOMOLOG OP DISCS LARGE 5; DLG5. This protein is also known as PLACENTA AND PROSTATE DLG and as PDLG. This sequence maps to gene map locus 10q23.

Vertebrate homologs of the *Drosophila* discs large (dlg) gene are members of the MAGUK (membrane-associated guanylate kinase) family. MAGUK proteins contain PDZ motifs, an SH3 domain, and a guanylate kinase (GUK)-homologous region. Both the PDZ and GUK domains are thought to contribute to protein-protein interactions. By searching an EST database for sequences related to *Drosophila* dlg, Nakamura et al. (1998) identified cDNAs encoding a novel human homolog. Northern blot analysis revealed that the 9.4-kb transcript was highly expressed in placenta and prostate, as well as in several other tissues, leading the authors to designate the gene PDLG (placenta and prostate DLG). An additional 8.8-kb PDLG mRNA was detected in thyroid. The predicted 859-amino acid PDLG protein contains 3 PDZ domains, an SH3 domain, and a GUK region. PDLG is 45% and 40% identical to DLG1 (601014) and *Drosophila* dlg, respectively. Western blot analysis of extracts of human prostate tissue and various cell lines showed that PDLG has an apparent molecular mass of 105 kD. Immunofluorescence experiments indicated that PDLG is localized at the plasma membrane and cytoplasm, and is expressed in the gland epithelial cells of normal prostate tissue but not in prostate cell lines. Using a yeast 2-hybrid screen, Nakamura et al. (1998) determined that PDLG interacts with the GUK domain of p55 (MPP1; 305360), a palmitoylated erythrocyte membrane MAGUK protein. The authors suggested that PDLG and p55 form a heteromeric MAGUK complex at the plasma membrane and cluster various intracellular molecules to play roles in maintaining the structure of epithelial cells and transmitting extracellular signals to the membrane and cytoskeleton.

Independently, Nagase et al. (1998) identified KIAA0583, a DLG5 cDNA. By radiation hybrid analysis, they mapped the DLG5 gene to chromosome 10. Using the same technique, Nakamura et al. (1998) refined the localization of the DLG5 gene to 10q23.

Another sequence (Lab Designation L28AP_rE (SEQ ID NO: 172)) comprises sequence encoding TRANSCRIPTION ELONGATION FACTOR B, 3 or TCEB3. This protein is also known as ELONGIN A and ELONGIN, 110-KD. This sequence maps to chromosomal location 1p36.1

Eukaryotic transcription and mRNA synthesis are complex biochemical processes controlled in part by the concerted action of a set of general transcription factors that regulate the activity of RNA polymerase II at both the initiation and elongation stages of transcription. Aso et al. (1995) noted that several general initiation factors, including TFIIA (see 600520), TFIIB (189963), TFIID (see 313650), TFIIE (see 189962), and TFIIH (see 189972), and several accessory proteins (e.g., TAFs; see 600475), have been identified in eukaryotic cells and found to promote selective binding of RNA polymerase II to promoters and to support a basal level of transcription.

Aso et al. (1996) described a full-length cDNA encoding the human homolog. The predicted 722-amino acid protein shares 84% homology with the rat protein. Comparison of the open reading frames of the human cDNA with that of the previously characterized rat cDNA indicated that they are 84% conserved in nucleotide sequence.

Duan et al. (1995) and Yibel et al. (1995) reported results suggesting that the tumor suppression activity of the von Hippel-Lindau tumor suppressor gene product (193300) is a function of its ability to bind to TCEB2 and TCEB1 and inhibit transcription elongation.

By fluorescence in situ hybridization, Aso et al. (1995) mapped the TCEB3 gene to 1p36.1. They pointed out that this region has been shown to have deletions in several forms of malignancy.

Another sequence (Lab Designation 14A7rE (SEQ ID NO: 113)) comprises sequence encoding MOTHERS AGAINST DECAPENTAPLEGIC, or *DROSOPHILA*, HOMOLOG OF, 7 or MADH7. This protein is also known as SMA- AND MAD-RELATED PROTEIN 7; SMAD7. This sequence maps to gene map locus 18q21.1

MAD proteins, originally defined in *Drosophila*, are essential components of the signaling pathways of the transforming growth factor-beta receptor family (e.g., TGFBR1; 190181). Using a differential display approach in cultured endothelial cells subjected to multiple soluble and biomechanical stimuli, Topper et al. (1997) isolated a human endothelial cell cDNA encoding MADH7, which they called SMAD7. The predicted 426-amino acid MADH7 protein lacks the C-terminal putative phosphorylation sites present in other MAD proteins, suggesting that it may be distinctly regulated. In situ hybridization and immunohistochemical analyses on human tissues showed that MADH7 is expressed predominantly in vascular endothelium. The authors demonstrated that MADH7 and MADH6 (602931) can form complexes in endothelial cells. MADH7 was induced in cultured vascular endothelium by fluid mechanical forces and was capable of modulating endothelial gene expression in response to both humoral and biomechanical stimuli in vitro.

Kavsak et al. (2000) found that the E3 ubiquitin ligase SMURF2 (605532) associates constitutively with SMAD7. SMURF2 is nuclear, but binding to SMAD7 induced export and recruitment to the activated TGFBR, where it caused degradation of receptors and of SMAD7 via proteasomal and lysosomal pathways. Gamma-interferon (IFNG; 147570), which stimulates expression of SMAD7, induced SMAD7-SMURF2 complex formation and increased TGFBR turnover, which was stabilized by blocking SMAD7 or SMURF2 expression. Furthermore, SMAD7 mutants that interfered with recruitment of SMURF2 to the receptors were compromised in their inhibitory activity. These studies defined SMAD7 as an adaptor in an E3 ubiquitin ligase complex that targets TGFBR for degradation.

Lallemand et al. (2001) showed that cells stably expressing SMAD7 had increased susceptibility to apoptosis induced by TGFB (190180), TNFA (191160), serum withdrawal, or loss of cell adhesion (anoikis). SMAD7 decreased NFKB (164011) activity, providing a mechanism for the increased apoptosis. Stable expression of RAS (190020) suppressed SMAD7 inhibition of NFKB and SMAD7 potentiation of apoptosis.

By somatic cell hybrid analysis, Topper et al. (1997) mapped the MADH7 gene to human chromosome 18. By FISH, Roijer et al. (1998) refined the localization to 18q21.1.

Another sequence (Lab Designation 14C__2E/rE (SEQ ID NO: 126)) comprises sequence encoding SIGNAL RECOGNITION PARTICLE, 19-KD (SRP19). This sequence maps to gene map locus 5q21-q22.

The signal recognition particle (SRP) is a ribonucleoprotein complex that mediates the targeting of proteins to the endoplasmic reticulum (ER). The complex consists of a 7S (or 7SL) RNA and 6 different proteins, SRP9 (600707), SRP14 (600708), SRP19, SRP54 (604857), SRP68 (604858), and SRP72 (602122). The proteins are bound to the 7S RNA as monomers (SRP19 and SRP54) or heterodimers (SRP9/SRP14 and SRP68/SRP72). SRP9 and SRP14 constitute the Alu domain of 7S, whereas the other 4 proteins belong to the S domain. SRP has at least 3 distinct functions that can be associated with the protein subunits: signal recognition, translational arrest, and ER membrane targeting by interaction with the docking protein.

By screening a liver cDNA library with an anti-SRP19 probe, Lingelbach et al. (1988) isolated a human SRP19 cDNA encoding a 144-amino acid protein. Sequence analysis showed that SRP19 contains a very basic C-terminal domain of 7 lysine residues interrupted by 2 glycine residues. Northern blot analysis revealed expression of a 0.9 kb transcript in HeLa cells. SDS-PAGE analysis showed that SRP19 is expressed as a 19-kD protein, identical in size to canine SRP19. Functional analysis determined that the SRP19 protein binds to 7SL RNA in canine pancreas.

In 2 small nested deletions of 100 to 260 kb identified by Joslyn et al. (1991) in patients with adenomatous polyposis coli (APC; 175100), Groden et al. (1991) identified 3 genes in a span of about 100 kb on chromosome 5. One of these was DP1 (125265); a second was the gene that is mutant in APC (175100), called by them DP2.5. A third was a gene which was found to have the same sequence as that of SRP19. SRP19 was shown to have 5 exons and to lie between DP1 and DP2.5. Horii et al. (1993) discussed the occurrence of alternative splicing not only within the APC gene but also between the APC gene and the neighboring SRP19 gene.

Wild et al. (2001) reported the 1.8-angstrom resolution crystal structure of human SRP19 in complex with its primary binding site on helix 6 of SRP RNA, which consists of a stem-loop structure closed by an unusual GGAG tetraloop. Protein-RNA interactions are mediated by the specific recognition of a widened major groove and the tetraloop without any direct protein-base contacts and include a complex network of highly ordered water molecules. Wild et al. (2001) proposed a model of the assembly of the SRP core comprising SRP19, SRP54, and SRP RNA based on crystallographic and biochemical data.

Another sequence (Lab Designation 14C__24__#6_Lac (SEQ ID NO: 47)) comprises sequence encoding FER-1, *C. ELEGANS*, HOMOLOG-LIKE 3; FER1L3. This protein is also known as MYOFERLIN or MYOF. This sequence maps to gene map location 10q23.32.

Dysferlin (DYSF; 603009), the gene product of the limb-girdle muscular dystrophy 2B locus (LGMD2B; 253601), encodes a membrane-associated protein with homology to *Caenorhabditis elegans* fer-1. Humans with mutations in dysferlin develop muscle weakness that affects both proximal and distal muscles. Strikingly, the phenotype in LGMD2B patients is highly variable, but the type of mutation in DYSF did not explain this phenotypic variability. Through electronic database searching, Davis et al. (2000) identified a protein highly homologous to dysferlin that they named myoferlin. The open reading frame of myoferlin predicted a 2,061-amino acid protein. By Northern blot analysis, the authors observed a 7.5-kb myoferlin mRNA transcript highly expressed in cardiac muscle and to a lesser degree in skeletal muscle. However, antibodies raised against myoferlin showed abundant expression of myoferlin (molecular weight 230 kD) in both cardiac and skeletal muscle. Within the cell, myoferlin was associated with the plasma membrane but, unlike dysferlin, myoferlin was also associated with the nuclear membrane. Ferlin family members contain C2 domains, and these domains play a role in calcium-mediated membrane fusion events. To investigate this, Davis et al. (2000) studied the expression of myoferlin in the mdx mouse, which lacks dystrophin and whose muscles undergo repeated rounds of degeneration and regeneration. They found upregulation of myoferlin at the membrane in mdx skeletal muscle. Davis et al. (2000) suggested myoferlin (MYOF) as a candidate gene for muscular dystrophy and cardiomyopathy, or possibly a modifier of the muscular dystrophy phenotype.

Another sequence (Lab Designation 14__7#2E-rE (SEQ ID NO: 5 and SEQ ID NO: 115)) comprises sequence encoding ALPHA-1,3-@MANNOSYL-GLYCOPROTEIN BETA-1,2-N-ACETYLGLUCOSAMINYLTRANSFERASE or MGAT1. This protein is also known as GlcNAc-T I, MGAT, UDP-N-ACETYLGLUCOSAMNE:ALPHA-3-D-MANNOSIDE BETA-1,2-N-ACETYLGLUCOSAMINYL-TRANSFERASE I (GLCT1). This sequence maps to gene map locus 5q35.

There are believed to be over 100 different glycosyltransferases involved in the synthesis of protein-bound and lipid-bound oligosaccharides. One of these, UDP-N-acetylglucosamine:alpha-3-D-mannoside beta-1,2-N-acetylglucosaminyltransferase I (GlcNAc-T I; EC 2.4.1.101), is a medial-Golgi enzyme essential for the synthesis of hybrid and complex N-glycans. Kumar and Stanley (1989) identified the human gene encoding N-acetylglucosaminyltransferase I by complementation of the glycosylation defect in the Lec1 Chinese hamster ovary (CHO) cell mutant. Kumar et al. (1990) cloned the gene. The overall features of the cDNA and deduced protein sequence (445 amino acids) were typical of other Golgi transferases that are type II transmembrane proteins. Hull et al. (1991) isolated 2 overlapping genomic DNA clones which span 18 kb containing the single 2,5-kb exon for GlcNAc-T I. The exon includes most of the 5-prime untranslated region, the complete coding sequence (1,335 bases, 445 amino acids), and the complete 3-prime untranslated region. Southern blot analysis indicated that the gene (symbolized GLCT1) exists in single copy in the human genome, and study of human-hamster somatic cell hybrids indicated that the gene is located on chromosome 5. Pownall et al. (1992) demonstrated that the sequence of the mouse gene Mgat1 is highly conserved with respect to the human and rabbit homologs and exists as a single protein-encoding exon. They mapped the gene to mouse chromosome 11, closely linked to the gene encoding IL3 (147740), by the analysis of multilocus interspecies backcrosses. Thus, the human gene may be in the same area as IL3, i.e., 5q23-q31. Kumar et al. (1992) mapped the gene to 5q31.2-q31.3 by in situ hybridization. Tan et al. (1995) reported that the MGAT1 gene maps to 5q35 by fluorescence in situ hybridization. They considered the discrepancy with the findings of Kumar et al. (1992) to be due to greater precision of fluorescence analysis compared with radioactive in situ hybridization. Shows (1999) stated that by use of more sensitive FISH technology than that used in their 1992 report (Kumar et al., 1992), he and his colleagues confirmed the assignment of the MGAT1 gene to 5q35.

Another sequence (Lab Designation 19_9BE_rE (SEQ ID NO: 123)) comprises sequence encoding CLEAVAGE STIMULATION FACTOR, 3-PRIME PRE-RNA, SUBUNIT 2,64-KD (CSTF2). This sequence maps to human chromosome Xq21.33.

Polyadenylation of mRNA is a complex process that requires multiple protein factors, including 3 cleavage stimulation factors (CSTF1, 600369; CSFT2, and CSTF3, 600367). CstF2, a 64-kD protein, contains a ribonucleoprotein (RNP)-type RNA binding domain in the N-terminal region (Takagaki et al., 1992). The CstF2 protein expressed in *E. coli* can be cross-linked to RNAs containing polyadenylation signal sequences (AAUAAA).

The concentration of one CSTF subunit (CSTF-64) increases during activation of B cells, and this is sufficient to switch IgM heavy chain mRNA expression from membrane-bound form to secreted form (Takagaki et al., 1996). To extend this observation, Takagaki and Manley (1998) disrupted the endogenous CstF-64 gene in the chicken B-cell line DT40 and replaced it with a regulatable transgene. Strikingly, a 10-fold decrease in CstF-64 concentration did not markedly affect cell growth but specifically and dramatically reduced accumulation of IgM heavy chain mRNA. Further reduction caused reversible cell cycle arrest in G0/G1 phase, while depletion resulted in apoptotic cell death.

Another sequence (Lab Designation 1A_A549_6-rE SEQ ID NO: 310)) comprises sequence encoding RET FINGER PROTEIN 2 (RFP2). This protein is also known as LEU5. This sequence maps to gene map locus 13q14.3

B-cell chronic lymphocytic leukemia is often associated with the loss of a region on chromosome 13q14 between the retinoblastoma gene (RB1; 180200) and locus D13S25 (Liu et al., 1993; Liu et al., 1995), suggesting that a tumor suppressor gene may be located in this region. By constructing a cosmid contig corresponding to the minimally deleted region and screening a pre-B lymphocyte cDNA library, Kapanadze et al. (1998) isolated several clones, one of which contained an ORF encoding a deduced 407-amino acid protein, RFP2, which they called LEU5. RFP2 contains a zinc finger domain of the RING type and shares significant homology with the RET finger protein (RFP; 602165) and the tumor suppressor gene BRCA1 (113705). Kapanadze et al. (1998) mapped the RFP2 gene close to D13S272, bordering the minimally deleted region.

Another sequence (Lab Designation 31_3_5_rE (SEQ ID NO: 158)) comprises sequence encoding ZINC FINGER PROTEIN 207 (ZNF207). This sequence maps to gene map locus 6p21.3.

Pahl et al. (1998) isolated a human vascular smooth muscle cell cDNA encoding a protein that they designated ZNF207. The predicted 478-amino acid protein is composed of nearly 20% proline residues and contains a potential nuclear localization signal at the N-terminus and 2 C2H2 zinc finger motifs. Northern blot analysis revealed that ZNF207 is expressed ubiquitously.

By fluorescence in situ hybridization, Pahl et al. (1998) mapped the ZNF207 gene to 6p21.3. Rasooly (1999) noted that the ZNF207 sequence is contained within a cloned region from chromosome 17 (AC005899).

Another sequence (Lab Designation 21_5_7E_Lac (SEQ ID NO: 137)) comprises sequence encoding INHIBITOR OF DNA BINDING 3 (ID3). This protein is also known as HEIR1 and the sequence maps to gene map locus 1p36.13-p36.12

Ellmeier et al. (1992) isolated a novel human gene encoding a helix-loop-helix (HLH) protein by molecular cloning of chromosome 1p36-specific CpG islands. Initially termed HEIR1, the ID3 gene was localized to the neuroblastoma consensus deletion region, 1p36.2-p36.12. Its predicted protein was 95.8% identical to the mouse HLH462 protein and had clear homology to the mouse Id and *Drosophila* emc proteins. The gene was expressed at high abundance in adult lung, kidney, and adrenal medulla, but not in adult brain. Despite prominent HEIR1 expression in adrenal medulla, which is a prime target for neuroblastomas, 10 of 12 neuroblastoma-derived cell lines showed very low levels of HEIR1 mRNA. Low HEIR1 expression was generally found in tumor cell lines with NMYC (164840) overexpression, whereas the 2 cell lines displaying high HEIR1 levels did not overexpress NMYC. Mutually exclusive expression of the 2 genes was also found by in situ hybridization in developing mouse tissues, particularly in the forebrain neuroectoderm. Ellmeier et al. (1992) concluded that HEIR1 expression is reduced specifically in the majority of neuroblastomas and suggested an inverse correlation between HEIR1 and NMYC expression in these tumors and in embryonic development.

Deed et al. (1994) reported a comparison of the ID3 gene with ID1 (600349) and ID2 (600386) that showed a highly conserved protein-coding gene organization consistent with evolution from a common ancestral gene. By using a YAC clone of ID3 for fluorescence in situ hybridization, they mapped the ID3 gene to 1p36.1. White et al. (1995) could exclude ID3 as a candidate for the neuroblastoma suppressor gene because it lies outside the loss of heterozygosity (LOH) region revealed by neuroblastoma studies (see NBS; 256700).

Id proteins may control cell differentiation by interfering with DNA binding of transcription factors. Lyden et al. (1999) demonstrated that the targeted disruption of Id1 and Id3 in mice results in premature withdrawal of neuroblasts in the cell cycle and expression of neural-specific differentiation markers. Lyden et al. (1999) crossed Id1+/− and Id3+/−mice. Offspring lacking 1 to 3 Id alleles in any combination were indistinguishable from wildtype, but no animals lacking all 4 Id alleles were born. The Id1-Id3 double knockout mice displayed vascular malformations in forebrain and absence of branching and sprouting of blood vessels in the neuroectoderm. As angiogenesis both in the brain and in tumors requires invasion of avascular tissue by endothelial cells, Lyden et al. (1999) examined Id knockout mice for their ability to support the growth of tumor xenografts. Three different tumors failed to grow and/or metastasize in Id1+/−Id3−/− mice, and any tumor growth present showed poor vascularization and extensive necrosis. Lyden et al. (1999) concluded that Id genes are required to maintain the timing of neuronal differentiation in the embryo and invasiveness of the vasculature. Because the Id genes are expressed at very low levels in adults, they make attractive targets for antiangiogenic drug design. Lyden et al. (1999) also concluded that the premature neuronal differentiation in Id1-Id3 double knockout mice indicates that ID1 or ID3 is required to block the precisely timed expression and activation of positively acting bHLH proteins during murine development.

Pan et al. (1999) found that Id3-deficient mice had no overt abnormalities but had compromised humoral immunity. After immunization with T cell-dependent or T cell-independent antigens, the responses of Id3-deficient mice were attenuated and severely impaired, respectively. T-cell proliferative responses appeared to be intact, but IFNGamma expression may have been impaired. The defect in B-cell proliferation could be rescued by ectopic expression of Id1.

ID3 is an inhibitor of E proteins, such as E2A (147141). By Northern and Western blot analysis, Kee et al. (2001) showed that in mouse transforming growth factor-beta (190180) rapidly induced transient Id3 expression in B-lymphocyte precursors. This induction involved activation of the SMAD (see 602932) transcription factor pathway.

Another sequence (Lab Designation 31_3_6_2_Lac (SEQ ID NO: 248)) comprises sequence encoding FK506-BINDING PROTEIN 8 (FKBP8). This protein is also known as FK506-BINDING PROTEIN, 38-KD (KBP38)).

FKBPs are intracellular receptors for the immunosuppressive drug FK506. The FKBP/FK506 complex exerts its immunosuppressive effects by inhibiting calcineurin (e.g., PPP3CA; 114105), a calcium- and calmodulin (e.g., CALM1; 114180)-dependent serine/threonine phosphatase that functions as a critical signaling molecule during T-cell activation. By PCR using Jurkat cell cDNA and degenerate oligonucleotides based on conserved regions of FKBPs, Lam et al. (1995) identified a cDNA encoding FKBP8. The deduced 355-amino acid FKBP8 protein shares 26 to 28% amino acid sequence identity with other known human FKBPs. FKBP8 contains an N-terminal domain that is 33% identical to FKBP12 (FKBP1A; 186945), a putative leucine zipper domain, a 3-unit imperfect tetratricopeptide repeat (TPR) domain, and a putative calmodulin-binding domain. Northern blot analysis detected a single, approximately 1.35- to 2,4-kb FKBP8 transcript in all human tissues examined, with the highest expression in brain.

Another sequence (Lab Designation 31_3_9-rE (SEQ ID NO: 135)) comprises sequence encoding MAIL, a nuclear I kappa B protein that potentiates LPS-induced IL 6 production. This sequence maps to gene map locus 3q21.3.

Kitamura et al. identified and characterized a novel member of the ankyrin-repeat family named 'molecule possessing ankyrin-repeats induced by lipopolysaccharide' (MAIL). The C-terminal portion of MAIL shared high sequence homology with the I kappa B family. Intraperitoneal injection of lipopolysaccharide (LPS) into mice rapidly (<0.5 h) induced MAIL mRNA in various tissues, particularly in the spleen, lymph node, and lung. Ectopically expressed MAIL was localized in the nucleus, and remarkably potentiated the LPS-induced mRNA expression and secretion of interleukin (IL)-6 in Swiss 3T3 cells. These findings indicated that MAIL is one of the nuclear I kappa B proteins and an activator of IL-6 production.

Another sequence (Lab Designation 34X23_1-rE (SEQ ID NO: 149)) comprises sequence encoding CASPASE RECRUITMENT DOMAIN-CONTAINING PROTEIN 4 (CARD4). This protein is also known as NOD1 PROTEIN (NOD1). This sequence maps to gene map locus 7p15-p14.

APAF1 (602233) in mammals and Ced4 in the worm are members of a family of intracellular proteins composed of an N-terminal caspase recruitment domain (CARD), a centrally located nucleotide-binding domain (NBD), and a C-terminal regulatory domain, which consists of WD40 repeats in the case of APAF1. The APAF1 WD40 repeats act as recognition domains for mitochondrial damage, which leads to APAF1 oligomerization and eventual apoptosis through homophilic CARD-CARD interaction with the prodomain of caspase-9 (CASP9; 602234).

By searching a proprietary EST database for sequences encoding CARD motifs, followed by screening an endothelial cell cDNA library, Berfin et al. (1999) obtained a cDNA encoding CARD4. The deduced 953-amino acid CARD4 protein contains an N-terminal CARD motif, an NBD, and unlike APAF1, 10 tandem leucine-rich repeats in its C terminus. Northern blot analysis revealed abundant expression of a 4,5-kb transcript in adult heart, spleen, and lung, as well as in numerous cancer cell lines and fetal tissues. Yeast 2-hybrid analysis using the CARD domain of CARD4 as bait to screen breast, prostate, and brain cDNA libraries, as well as coimmunoprecipitation analysis, indicated preferential interaction with the CARD of RICK (RIPK2; 603455). Luciferase reporter analysis showed that the CARD domain of CARD4, but not that of APAF1, potently induces activation of nuclear factor kappa-B (see 164011), but not of JUN N-terminal kinase (see 601158), in a concentration-dependent manner.

Using similar methods, Inohara et al. (1999) cloned and characterized CARD4, which they called NOD1. Northern blot analysis detected wide expression of NOD1. In situ hybridization analysis showed relatively restricted expression of Nod1 in day-15.5 mouse embryos. Confocal microscopy demonstrated that NOD1 is a cytosolic protein. Coimmunoprecipitation analysis revealed that NOD1 preferentially interacts with procaspases containing CARDs or death effector domains (DEDs), as well as with itself, RICK, and CLARP (CFLAR; 603599), but not with RAIDD (CRADD; 603454), APAF1, NIK (604655), or other CARD- or DED-containing proteins. Functional analysis indicated that the CARD and NBD of NOD1, but not the LRR, enhance apoptosis induced by CASP9, but not by other caspases or CLARP. The CARD was found to be essential for NOD1 to bind and activate CASP9, as well as to promote apoptosis. Inohara et al. (1999) also observed that NOD1 interacts with RICK in NFKB activation.

By genomic sequence analysis, Inohara et al. (1999) determined that the NOD1 gene contains 7 coding and 7 noncoding exons and maps to 7p15-p14.

Another sequence (Lab Designation 34X23_3-rE (SEQ ID NO: 152)) comprises sequence encoding mdr1b or mdr1. This protein is also known as Abcb1b. This sequence maps to human chromosomal location 7q21.1.

Song et al. "Identification and characterization of a hepatoma cell-specific enhancer in the mouse multidrug resistance mdr1b promoter" *J Biol Chem.*, 270(43):25468-74) (Oct. 27, 1995) demonstrate that the expression of multidrug resistance/P-glycoprotein genes mdr1b(mdr1) and mdr1a(mdr3) is elevated during hepatocarcinogenesis. To investigate the regulation of mdr1b gene expression, they used transient transfection expression assays of reporter constructs containing various 5'-mdr1b flanking sequences in hepatoma and non-hepatoma cells. They found that nucleotides −233 to −116 preferentially enhanced the expression of reporter gene in mouse hepatoma cell lines in an orientation- and promoter context-independent manner. DNase I footprinting using nuclear extracts prepared from hepatoma and non-hepatoma cells identified four protein binding sites at nucleotides −205 to −186 (site A), −181 to −164 (site B), −153 to −135 (site C), and −128 to −120 (site D). Further analyses revealed that, while site B alone played a major part for the enhancer function, sites A and B combined conferred full enhancer activity. Site-directed mutagenesis results also supported these results. Gel retardation experiments using oligonucleotide competitors revealed that the site B contains a dominant binding protein. This was the first report demonstrating a cell type-specific enhancer in the mdr locus. The role of this enhancer in the activation of mdr1b gene during hepatocarcinogenesis is discussed by the authors.

Hsu et al. "Differential overexpression of three mdr gene family members in multidrug-resistant J774.2 mouse cells. Evidence that distinct P-glycoprotein precursors are encoded by unique mdr genes" *J Biol Chem*, 15; 264(20):12053-62, (July 1989) show that a hallmark of the multidrug-resistant phenotype is the overproduction of a family of 130-180-kDa integral membrane phosphoglycoproteins collectively called P-glycoprotein. Gene-specific hybridization probes were derived from three classes of mouse P-glycoprotein cDNAs. These probes revealed the differential amplification and/or transcriptional activation of three distinct but closely related mdr genes (mdr1a, mdr1b, and mdr2) in independently selected multidrug-resistant J774.2 mouse cell lines. Overexpression of mdr1a and mdr1b was found to correlate, in general, with the differential overproduction of either a 120- or 125-kDa P-glycoprotein precursor, respectively. This same correlation was observed in a single cell line during the course of stepwise selection for resistance to vinblastine in which a switch in gene expression from mdr1b to mdr1a resulted in a switch from the 125- to 120-kDa P-glycoprotein precursor. These findings suggest that differential overexpression of distinct mdr genes which encode unique P-glycoprotein isoforms is a possible mechanism for generating diversity in the multidrug-resistant phenotype.

Another sequence (Lab Designation 34X24_126-rE (SEQ ID NO: 148)) comprises sequence encoding MITOGEN-ACTIVATED PROTEIN KINASE KINASE KINASE 7-INTERACTING PROTEIN 1 (MAP3K7IP1). This protein is also known as TAK1-BINDING PROTEIN 1 or TAB1. This sequence maps to Gene map locus Chr.22.

Shibuya et al. (1996) used the yeast 2-hybrid system to identify brain cDNAs encoding proteins that interacted with TAK1 (602614). They recovered a gene encoding a predicted 504-amino acid protein that they named TAB1 (TAK1-binding protein-i). On Northern blots, TAB1 was expressed as a 3.5-kb mRNA in all tissues tested.

Shibuya et al. (1996) found that in both yeast and mammalian cells, TAB1 activated the kinase activity of TAK1 by direct interaction. They showed that the C-terminal 68 amino acids of TAB1 are sufficient for binding and activation of TAK1 in mammalian cells, while the N-terminal 418 amino acids act as a dominant-negative inhibitor of transforming growth factor-beta (TGFB; 190180)-induced gene expression. Since TAK1 functions as a MAPKKK in the TGFB signaling pathway, Shibuya et al. (1996) suggested that TAB1 may be an important signaling intermediate between TGFB receptors and TAK1.

Using a yeast 2-hybrid screen of gastrointestinal tract tissue with p38-alpha (MAPK14; 600289) as the bait, Ge et al. (2002) isolated multiple clones encoding TAB1. Immunoprecipitation and GST pull-down analyses indicated that TAB1 interacts with p38-alpha, but not with other MAPKs, with or without treatment with TNF (191160). Immunoblot analysis showed that coexpression of TAB1 and p38-alpha enhanced autophosphorylation of p38-alpha even in the presence of dominant-negative forms of MAP2Ks (e.g., MAP2K3; 602315) and TAK1. The amino acids between positions 373 and 418 of TAB1 were found to be required for phosphorylation of p38-alpha. Expression of TLR2 (603028) caused p38-alpha phosphorylation in the presence or absence of inhibitors, whereas p38-alpha phosphorylation after stimulation of TLR4 (603030) could be inhibited by mutant TAB1, suggesting that activation of p38-alpha can be TAB1 dependent or independent. Immunoblot analysis detected the formation of TRAF6 (602355)-TAB1-p38-alpha complexes. Formation of these complexes could be enhanced by stimulation with lipopolysaccharide. Ge et al. (2002) concluded that activation of p38-alpha by a nonenzymatic adaptor protein such as TAB1 may be an important alternative activation pathway operating in parallel with kinase cascades in regulating intracellular signaling.

The International Radiation Hybrid Mapping Consortium mapped the TAB1 gene to chromosome 22 (WI-18691).

Another sequence (Lab Designation 36_5_2_6-rE (SEQ ID NO: 150)) comprises sequence encoding BROMODOMAIN-CONTAINING PROTEIN 2 (BRD2). This protein is also known as FEMALE STERILE HOMEOTIC-RELATED GENE 1, MOUSE HOMOLOG OF FSRG1 (RING3). This sequence maps to gene map locus 6p21.3.

In a search for novel genes in the human major histocompatibility complex (MHC) class II region on chromosome 6p21.3, Okamoto et al. (1991) and Beck et al. (1992) identified a gene that they termed RING3 ('RING' is an acronym for 'really interesting new gene.'). Based on mapping and genomic sequencing, RING3 was located in the middle of the class II region between the genes HLA-DNA (142930) and HLA-DMA (142855). In contrast to all the other genes encoded in the class II region, RING3 appeared to have no obvious function associated with the immune system based on sequence comparisons. The striking sequence similarity to the female sterile homeotic (fsh) gene in *Drosophila*, however, suggested a conserved biologic function for RING3. Denis and Green (1996) discovered that the RING3 product is, in fact, a mitogen-activated nuclear kinase involved in signal transduction and that it is upregulated in certain types of leukemia. With the aim of learning more about the phylogeny of RING3, Thorpe et al. (1996) identified further homologs in different species and determined their gene structures. The functional analysis of RING3 had been further complicated by the finding of a second, non-MHC-linked copy of RING3 in humans by Nomura et al. (1994). This was referred to by them as ORFX (601541). Using a PCR probe derived from the ORFX cDNA sequence, Thorpe et al. (1996)

mapped ORFX to 9q34 by fluorescence in situ hybridization analysis. Several other MHC-related genes had been reported to map to the same region of 9q.

Another sequence (Lab Designation 3_2_13-rE (SEQ ID NO:192)) comprises sequence encoding S100 CALCIUM-BINDING PROTEIN A6 (S100A6). This protein is also known as calcyclin. This sequence maps to gene map locus 1q21.

Calcyclin was originally defined as a cDNA clone (2A9) whose cognate RNA was found to be growth-regulated and whose sequence showed strong similarities to that of the S-100 protein, a calcium-binding protein, as well as to a subunit of the major cellular substrate for tyrosine kinase. Using a full-length cDNA, Ferrari et al. (1987) isolated the entire calcyclin gene plus extensive flanking sequences. They found that the calcyclin gene is present in single copy and has 3 exons. By in situ hybridization, they determined that the CACY gene is located in the 1q21-q25 segment. By linkage studies of interspecific backcrosses of Mus spretus and Mus musculus domesticus, Seldin (1989) demonstrated that the Cacy gene is located on mouse chromosome 3. Using cDNA probes for CACY, van Heyningen et al. (1989) and Dorin et al. (1990) showed that the gene cosegregates with CAGA (S100A8; 123885) and CAGB (S100A9; 123886), which are located on 1q12-q21.

In the course of constructing a physical map of human 1q21-q23, Oakey et al. (1992) determined that the CACY gene is located at the centromeric end of that segment, proximal to SPTA1 (182860).

Schafer et al. (1995) isolated a YAC from 1q21 on which 9 different genes coding for S100 calcium-binding proteins could be localized. The clustered organization of S100 genes allowed introduction of a new logical nomenclature based on their physical arrangement on the chromosome with S100A1 (176940) being closest to the telomere and S100A9 being closest to the centromere. In the new nomenclature, CACY became S100A6.

RhoGEFs play an important role in various signaling cascades and are implicated in human conditiions like cancer and mental retardation (Thiesen et al. "Isolation of two novel human RhoGEFs, ARHGEF3 and ARHGEF4, in 3p13-21 and 2q22" Biochem Biophys Res Commun, 273(1):364-9, Jun. 24, 2000). A database search combined with screening of a human neuronal teratocarcinoma library identified two novel RhoGEFs, ARHGEF3 and ARHGEF4 (HGMW-approved symbols). The widely expressed ARHGEF3 transcript of 3561 nucleotides encodes a polypeptide of 526 amino acids with homology to NET1. The ARHGEF4 gene generates two transcripts of 3665 and 4000 nucleotides that translate into 720 amino acid residues. Expression of ARHGEF4 is restricted to brain and the encoded protein shows homology to collybistin. FISH analysis of genomic clones mapped ARHGEF3 to 3p13-21 and ARHGEF4 to 2q22. Copyright 2000 Academic Press.

Another sequence (Lab Designation 49_RA2_A-rE (SEQ ID NO: 311)) comprises sequence encoding HETEROGENEOUS NUCLEAR RIBOPROTEIN L; HNRPL Heterogeneous nuclear ribonucleoprotein (hnRNP) complexes are the structures that contain hnRNAs and their associated proteins. The hnRNPs are directly involved in mRNA synthesis and maturation. Their protein content consists of 2 principal categories: a family of 3 related major species with common structural features, the so-called A1-A2, B1-B2, C1-C2 core proteins, and a more heterogeneous population of polypeptides designated D to U. There are over 20 different major polypeptides in the molecular mass range of 34,000 to 120,000 Da that are associated with the hnRNA in HeLa cells. Among these is a set of 2 distinct, approximately 68-kD proteins, designated L (HNRPL) and M. By UV crosslinking proteins to RNA and by sedimentation analysis before and after RNase digestion, Pinol-Roma et al. (1989) demonstrated with a monoclonal antibody against HNRPL that HNRPL is stably associated with hnRNP complexes. They also showed that HNRPL is present in the nucleoplasm, in 1 to 3 unidentified discrete nonnucleolar structures, and outside hnRNP complexes. The authors detected HNRPL in various vertebrates and found that HNRPL is associated with most nascent transcripts on the lampbrush chromosomes of the newt N. viridescens. Pinol-Roma et al. (1989) screened a HeLa cell cDNA expression library with serum containing antibodies against hnRNPs and isolated a cDNA encoding HNRPL. Northern blot analysis detected an approximately 2.3-kb HNRPL transcript in HeLa cells. The predicted 558-amino acid protein is glycine- and proline-rich and has a calculated molecular weight of 60,187 Da. HNRPL contains 2 segments of approximately 80 amino acids each that are weakly related to each other and to the ribonucleoprotein consensus sequence-type RNA-binding domains of other hnRNP and snRNP proteins.

Another sequence (Lab Designation 6B37H_T7 (SEQ ID NO:65)) comprises sequence encoding ANNEXIN A1 (ANXA1). This protein is also known as ANNEXIN I (ANX1), LIPOCORTIN I (LPC1) and CALPACTIN II. This sequence maps to Gene map locus 9q11-q22.

The antiinflammatory action of glucocorticoids has been attributed to the induction of a group of proteins, collectively called lipocortin, that inhibit phospholipase A2. These proteins are thought to control the biosynthesis of potent mediators of inflammation, prostaglandins and leukotrienes, by inhibiting release of their common precursor, arachidonic acid, a process that requires hydrolysis of phospholipids by phospholipase A2. Lipocortin-like proteins have been isolated from monocytes, neutrophils, renal medullary cells, and other cell types. The predominant active form has an apparent relative molecular mass of 40,000. Partially purified lipocortin mimics the effect of steroids and mediates antiinflammatory activity in various in vivo model systems. Using amino acid sequence information from purified rat lipocortin, Wallner et al. (1986) cloned cDNA for human lipocortin and expressed the gene in E. coli. They confirmed that LPC is a potent inhibitor of phospholipase A2. Lipocortin I belongs to the family of annexins, which are structurally related proteins that have a molecular mass of approximately 35,000 to 40,000. They undergo Ca(2+)-dependent binding to phospholipids that are preferentially located on the cytosolic face of the plasma membrane. The individual proteins in this family have been discovered by investigators with various goals in mind and have been given a variety of names (Kaplan et al., 1988).

Crompton et al. (1988) reviewed the lipocortin/calpactin family of proteins. Pepinsky et al. (1988) described the characteristics of 3 proteins they called lipocortin III, lipocortin V, and lipocortin VI. Lipocortins III and IV are apparently identical. Shohat et al. (1989) advanced the hypothesis that familial Mediterranean fever (FMF; 249100) patients are homozygous for a mutant allele for one of the lipocortin genes.

Walther et al. (2000) showed that ANXA1 acts through the formyl peptide receptor (FPR; 136537) on human neutrophils. Peptides derived from the unique N-terminal domain of ANXA1 serve as FPR ligands and trigger different signaling pathways in a dose-dependent manner. Lower peptide concentrations possibly found in inflammatory situations elicit Ca(2+) transients without fully activating the mitogen-activated protein kinase pathway. This causes a specific inhibition of the transendothelial migration of neutrophils and a desensitization of neutrophils toward a chemoattractant challenge. These findings identified ANXA1 peptides as novel, endogenous FPR ligands and established a mechanistic basis of ANXA1-mediated antiinflammatory effects.

Huebner et al. (1987, 1988) mapped the ANXA1 gene to 9q11-q22 by chromosomal in situ hybridization and segregation analysis in somatic cell hybrids using a cDNA clone.

Horlick et al. (1991) isolated overlapping mouse genomic clones for Lipo1. The gene in the mouse spans about 17 kb and is divided into 13 exons encoding a protein of 346 amino acid residues. By analysis of recombinant inbred strains, they showed that Lipo1 is located on chromosome 19. Horlick et al. (1991) pointed out a similarity in gene structure between mouse Lipo1 and Lipo2, suggesting that they have a recent evolutionary ancestor.

Another sequence (Lab Designation 6B60_Lac (SEQ ID NO:237)) comprises sequence encoding TROPOMYOSIN 1 (TPM1). This protein is also known as TROPOMYOSIN, SKELETAL MUSCLE ALPHA (TMSA). This sequence maps to gene map locus 15q22.1.

Tropomyosins are ubiquitous proteins of 35 to 45 kD associated with the actin filaments of myofibrils and stress fibers. In vertebrates, 4 known tropomyosin genes code for diverse isoforms that are expressed in a tissue-specific manner and regulated by an alternative splicing mechanism (Lees-Miller and Helfman, 1991). The vertebrate alpha-tropomyosin gene consists of 15 exons; 5 exons are found in all transcripts, while 10 exons are alternatively used in different alpha-tropomyosin RNAs (Lees-Miller and Helfman, 1991). The striated muscle isoform is expressed in both cardiac and skeletal muscle tissues.

MacLeod and Gooding (1988) isolated a cDNA clone from a human skeletal muscle library which contains the complete protein-coding sequence of a skeletal muscle alpha-tropomyosin. In cultured human fibroblasts, the TMSA gene was found to encode both skeletal muscle and smooth muscle type of alpha-tropomyosins by using an alternative mRNA-splicing mechanism.

Eyre et al. (1995) developed a sequence tagged site (STS) for the TPM1 gene and used it to isolate a genomic clone containing part of the gene. Using this clone, they localized TPM1 to 15q22 by fluorescence in situ hybridization. By PCR of radiation hybrids, Tiso et al. (1997) mapped the TPM1 gene more precisely to 15q22.1. Schleef et al. (1993) mapped the mouse homolog, Tpm-1, to the d-se region of chromosome 9, using interspecies backcrosses.

Brown et al. (2001) described the crystal structure of the tropomyosin molecule. Their results revealed the effects of clusters of core alanines on the axial register, symmetry, and conformational variability of 2-stranded coiled coils that appear to be important for tropomyosin's role in the regulation of muscle contraction.

To assess linkage between the human TPM1 gene and type 3 familial hypertrophic cardiomyopathy (CMH3; 115196), which had previously been mapped to 15q2, Thierfelder et al. (1994) identified a short tandem repeat polymorphism (STR). A combined maximum 2-point lod score of 6.94 at theta=0.0 was obtained for linkage of the TPM1 marker to CMH3 in 2 families. A point mutation was identified in each of the 2 families used in the linkage study: asp175-to-asn (191010.0002) in one, and glu180-to-gly (191010.0001) in the other. Watkins et al. (1995) concluded that mutations in the TPM1 gene are a rare cause of CMH, accounting for approximately 3% of cases. These mutations, like those in the cardiac troponin T gene (TNNT2; 191045), are characterized by relatively mild and sometimes subclinical hypertrophy but a high incidence of sudden death. Genetic testing may therefore be especially important in this group.

Blanchard et al. (1997) used gene targeting in embryonic stem cells and blastocyst-mediated transgenesis to create functional mouse alpha-tropomyosin knockouts. Homozygous mice died in utero between embryonic days 9.5 and 13.5 and lacked alpha-tropomyosin mRNA. Heterozygotes had an approximately 50% reduction in alpha-tropomyosin mRNA levels but no reduction in alpha-tropomyosin protein. No differences in myofibrillar ultrastructure or contractile function were found. The authors postulated that mice have a regulatory mechanism that maintains the level of myofibrillar tropomyosin despite a reduction in mRNA. Furthermore, they concluded that, assuming human and mouse cardiac muscle are similar, simple haploinsufficiency for alpha-tropomyosin would not cause the pathologic changes seen in human type 3 hypertrophic cardiomyopathy (115196) and that alterations in protein stoichiometry may produce a poison polypeptide that disrupts myofibrillar organization on incorporation into the sarcomere.

Muthuchamy et al. (1999) constructed a transgenic mouse model of CMH3 by introducing the missense mutation asp 175 to asn (191010.0002) by site-directed mutagenesis. This mutation occurs in a cardiac troponin T-binding region. The transgenic CMH3 mice exhibited significant in vivo and in vitro evidence of myocardial functional impairment. Histologic analysis of transgenic myocardium showed variable myocyte disarray and hypertrophy, as reported in the human form of the disease.

Allelic Variants 0.0001 CARDIOMYOPATHY, FAMILIAL HYPERTROPHIC, 3 [TPM1, GLU180GLY] In members of family MZ afflicted with a form of familial hypertrophic cardiomyopathy linked to 15q (115196), Thierfelder et al. (1994) identified an A-to-G transition at nucleotide 595 in exon 5 of the TPM1 gene in heterozygous state. The substitution changed codon 180 from GAG to GGG and predicted that a negatively charged glutamic acid residue is replaced by a neutral glycine residue.

0.0002 CARDIOMYOPATHY, FAMILIAL HYPERTROPHIC, 3 [TPM1, ASP175ASN] In members of family MI afflicted with a form of familial hypertrophic cardiomyopathy linked to 15q (115196), Thierfelder et al. (1994) found heterozygosity for a G-to-A transition at nucleotide 579 that altered codon 175 from GAC to AAC. The substitution predicted that the mutated allele present in affected individuals would encode a neutral asparagine residue instead of the negatively charged aspartic acid residue found in unaffected individuals.

Watkins et al. (1995) investigated whether the D175N mutation was really responsible for hypertrophic cardiomyopathy or was only a polymorphism, because some features of the 2 identified mutations in the alpha-tropomyosin gene contrasted with those of mutations in other disease genes for CMH. Unlike the beta-cardiac myosin heavy chain gene (MYH7; 160760) and the cardiac troponin-T gene, the alpha-tropomyosin gene is expressed ubiquitously, yet the disease phenotype is limited to cardiac muscle. Watkins et al. (1995) found that the asp175-to-asn missense mutation was present in the proband and 2 affected offspring, but in none of the proband's 3 sibs. Although both parents were deceased, the haplotypes of the 4 parental chromosomes could be reconstructed. (The haplotypes made use of an intragenic polymorphism in 10 flanking polymorphisms spanning a region of 35 cM.) One parental chromosome was transmitted to 2 offspring: 1 bearing the asp175-to-asn mutation (the affected proband) and 1 clinically unaffected sib who lacked the TPM1 mutation. Thus the asp175-to-asn mutation must have arisen de novo.

0.0003 CARDIOMYOPATHY, FAMILIAL HYPERTROPHIC, 3 [TPM1, VAL95ALA] Karibe et al. (2001) described a large Spanish-American family with multiple members affected with hypertrophic cardiomyopathy (115196). They found a novel val95-to-ala (V95A) mutation in TPM1 to segregate with the disease phenotype. This mutation was associated with the same mild degree of left ventricular hypertrophy as seen in some CMH1 families haboring specific mutations in MYH7 (160760.0010, 160760.0012, 160760.0001). Penetrance was estimated at 53% on the basis of an abnormal echocardiogram; however, 2 mutation carriers with normal echocardiograms and normal ECGs were only in their mid-30s at the time of the study. Penetrance could not be accurately assessed by ECG, since 6 older mutation-negative family members had minor T-wave changes. Cumulative survival rates in this family were 73%+/−10% at 40 years and 32%+/−13% at 60 years. Expression of mutant and control tropomyosin in a bacterial system allowed a functional assessment of this mutation. An increase in calcium binding and abnormal myosin cycling were observed; both were felt to be important contributors to disease pathogenesis.

Another sequence (Lab Designation 6b3_rE (SEQ ID NO: 1) comprises sequence encoding ATPase, H+ TRANSPORTING, LYSOSOMAL (ATP6L)

This protein is also known as ATPase, H+ TRANSPORTING, LYSOSOMAL, 16-KD This sequence maps to gene map locus 16p13.3.

In an attempt to isolate candidate genes for autosomal dominant polycystic kidney disease (173900), Gillespie et al. (1991) identified a number of CpG-rich islands from 16p13.3, the region defined genetically as containing the site of PKD1 (601313) mutations. Genomic fragments adjacent to one of these islands were used to isolate cDNAs from both HeLa cells and cultured cystic epithelium that encode a 155-amino acid peptide having 4 putative transmembrane domains. The corresponding transcript was found in all tissues tested but was most abundant in brain and kidney. The deduced amino acid sequence had 93% similarity to the 16-kD proteolipid component that is believed to be part of the proton channel of the vacuolar H(+)-ATPase. A mutated proton channel might be implicated in the pathogenesis of cystic disease. However, sequencing of cDNAs corresponding to both alleles of an affected person revealed no differences in the deduced amino acid sequence. Moreover, transcript size and abundance were not altered in cystic kidney.

Note: ABCR is a rearranged gene that is not expressed in our cell line—in the mouse, this gene sits next to Char4: P. chabaudi malaria resistance QTL 4—as well as several genes of unknown function. Murine chromosome 3 60.81-61.19 cM is the closest rodent markers. Human genes that reside next door are PARG1; LOC163462; and loc163463.

Another sequence (Lab Designation 6BE72_rE (SEQ ID NO: 2)) comprises sequence encoding CCCTC-BINDING FACTOR (CTCF). This protein is also known as TRANSCRIPTIONAL REPRESSOR CTCF.

Filippova et al. (1996) isolated and analyzed human CTCF (CCCTC-binding factor) cDNA clones. They showed that the human CTCF protein contains 11 zinc finger domains and is exceptionally highly conserved, sharing 93% identity with the avian CTCF amino acid sequence. It binds specifically to regulatory sequences in the promoter-proximal regions of chicken, mouse, and human MYC (190080) oncogenes. CTCF contains 2 transcription repressor domains transferable to a heterologous DNA-binding domain. One CTCF-binding site, conserved in mouse and human MYC genes, is found immediately downstream of the major P2 promoter. Gel shift assays of nuclear extracts from mouse and human cells showed that CTCF is the predominant factor binding to this sequence. Mutational analysis of the P2-proximal CTCF-binding site and transient cotransfection experiments demonstrated that CTCF is a transcriptional repressor of the human MYC gene. Although there is 100% sequence identity in the DNA-binding domains of the avian and human CTCF proteins, the regulatory sequences recognized by CTCF in chicken and human MYC promoters are clearly diverged. Mutating the contact nucleotides confirmed that CTCF binding to the P2 promoter of the human MYC gene requires a number of unique contact DNA bases that are absent in the CTCF-binding site of the chicken MYC gene. Moreover, proteolytic protection assays indicated that several more CTCF zinc fingers are involved in contacting the human CTCF-binding site than the chicken site. Gel shift assays utilizing successively deleted zinc finger domains indicated that CTCF zinc fingers 2 to 7 are involved in binding to the chicken MYC promoter, while fingers 3 to 11 mediate CTCF binding to the human promoter. This flexibility in zinc finger usage reveals CTCF to be a 'multivalent' transcription factor. Northern blot analysis revealed that the human CTCF gene is ubiquitously expressed as an approximately 4-kb transcript.

Bell et al. (1999) identified a 42-bp DNA fragment of the chicken beta-globin insulator that is both necessary and sufficient for enhancer-blocking activity in human cells. They showed that this sequence, FII, is the binding site for CTCF, and these CTCF-binding sites were present in all of the vertebrate enhancer-blocking elements examined. Bell et al. (1999) suggested that directional enhancer blocking by CTCF is a conserved component of gene regulation in vertebrates.

Bell and Felsenfeld (2000) and Hark et al. (2000) independently showed that CTCF binds to several sites within the unmethylated imprinted-control region (ICR) between H19 (103280) and IGF2 (147470) that are essential for enhancer blocking. Hark et al. (2000) demonstrated that CTCF binding is abolished by DNA methylation of the ICR. Methylation of the CpGs within the CTCF binding sites eliminates binding of CTCF in vitro, and deletion of these sites results in loss of enhancer-blocking activity in vivo, thereby allowing gene expression. This CTCF-dependent enhancer-blocking element acts as an insulator. Bell and Felsenfeld (2000) suggested that it controls imprinting of IGF2 and that activity of this insulator is restricted to the maternal allele by specific DNA methylation of the paternal allele. Bell and Felsenfeld (2000) concluded that DNA methylation can control gene expression by modulating enhancer access to the gene promoter through regulation of an enhancer boundary.

An expansion of a CTG repeat at the DM1 locus causes myotonic dystrophy by altering the expression of 2 adjacent genes, DMPK (605377) and SIX5 (600963) and through a toxic effect of the repeat-containing RNA. Filippova et al. (2001) identified 2 CTCF binding sites that flank the CTG repeat and form an insulator element between DMPK and SIX5. Methylation of these sites prevents binding of CTCF, indicating that the DM1 locus methylation in congenital myotonic dystrophy would disrupt insulator function. Furthermore, CTCF binding sites are associated with CTG/CAG repeats at several other loci. Filippova et al. (2001) suggested a general role for CTG/CAG repeats as components of insulator elements at multiple sites in the human genome.

Chao et al. (2002) identified the insulator and transcription factor CTCF as a candidate trans-acting factor for X chromosome selection in mouse. The choice/imprinting center contains tandem CTCF binding sites that function in an enhancer-blocking assay. In vitro binding is reduced by CpG methylation and abolished by including non-CpG methylation. Chao et al. (2002) postulated that Tsix (300181) and CTCF together establish a regulatable epigenetic switch for X inactivation. Murine Tsix contains greater than 40 CTCF motifs and the human sequence has greater than 10. Dot-plot analysis indicated a contiguous head-to-tail arrangement of highly homologous DXPas34 repeats.

Another sequence (Lab Designation 7A10_1-rE (SEQ ID NO: 41)) comprises sequence encoding DELETED IN AZOOSPERMIA-LIKE (DAZL). This protein is also known as DAZLA or DELETED IN AZOOSPERMIA HOMOLOG or DAZH or SPGYLA. This sequence maps to gene map locus 3p24. This gene was disrupted off the negative strand utilizing the methods of the present invention.

It is widely believed that most or all Y-chromosomal genes were once shared with the X chromosome. The DAZ gene (400003), so named for 'deleted in azoospermia,' is a candidate for AZF, the human Y-chromosomal azoospermia factor (415000). Saxena et al. (1996) reported multiple copies of DAZ (more than 99% identical in DNA sequence) clustered in the AZF region and a functional DAZ homolog (symbolized DAZH by them) on human chromosome 3. The entire gene family appeared to be expressed in germ cells. Sequence analysis indicated that the Y-chromosomal DAZ cluster arose during primate evolution by (1) transposition of the autosomal gene to the Y; (2) amplification and pruning of exons within the transposed gene; and (3) amplification of the modified gene. Saxena et al. (1996) stated that these results challenged prevailing views of sex chromosome evolution, suggesting that acquisition of autosomal fertility genes was an important process in Y chromosome evolution. By fluorescence in situ hybridization (FISH) and positioning on the radiation hybrid map of the human genome, Saxena et al. (1996) mapped the DAZH gene to 3p24. Saxena et al. (1996) suggested that DAZH is the founding member of the DAZ gene family.

Shan et al. (1996) cloned a human autosomal gene homologous to the DAZ gene by screening different testis libraries with the cDNA probe SPGY1. The gene, designated SPGYLA by them, was mapped to chromosome 3 by FISH. Shan et al. (1996) reported that comparison of the SPGYLA cDNA sequence with the cDNA sequences of DAZ and SPGY1 revealed 2 prominent differences. The tandem repetitive structure of 72-bp sequence units (DAZ repeats) is absent in SPGYLA, as SPGYLA contains only 1 72-bp sequence subunit. Downstream of this subunit a specific 130-bp sequence domain is present which is also present in the mouse Dazla gene (encoded on mouse chromosome 17) and in the *Drosophila* gene 'boule' but absent from DAZ. Shan et al. (1996) demonstrated that SPGYLA encodes an RNA-binding protein that is expressed only in the male gonad.

Yen et al. (1996) reported the isolation of a human gene homolog of the mouse Dazla gene by screening of a testis-specific library with a DAZ cDNA clone. The gene they isolated contained only 1 of 7 repeats found in DAZ, showed a high degree of homology to the mouse Dazla gene, and mapped to chromosome 3p24.

RBM and DAZ/SPGY are 2 families of genes located on the Y chromosome that encode proteins containing RNA-binding motifs, and both have been described as candidate human spermatogenesis genes. Neither gene family had been shown to be essential for spermatogenesis in human males, but a Dazla homolog in *Drosophila* is essential for spermatogenesis (Eberhart et al., 1996). With a polyclonal antibody raised in rabbits against Dazla and with knockout technology in mice, Rugglu et al. (1997) demonstrated that the Dazla protein is cytoplasmic in male and female germ cells, unlike the nuclear RBM protein. Disruption of the Dazla gene led to loss of germ cells and complete absence of gamete production, demonstrating that Dazla is essential for the differentiation of germ cells.

By a comparison of autosomal DAZLA and Y-linked DAZ intron sequences, Agulnik et al. (1998) derived a new figure for the ratio of male-to-male mutation rates; they found that alpha(m)=4.

The single-copy gene DAZL1 on chromosome 3 encodes a testis-specific protein with RNA-binding potential. Y-chromosomal DAZ homologs are confined to humans and higher primates. To investigate the function unique to higher primate spermatogenesis that DAZ may serve and to assess the functional status of the gene by determining the extent of functional conservation, Slee et al. (1999) tested the capacity of the human DAZ gene contained in a 225-kb YAC to complement the sterile phenotype of the Dazl null mouse, which is characterized by severe germ cell depletion and meiotic failure. Although Dazl −/− mice remained infertile when the DAZ transgene was introduced, histologic examination revealed a partial and variable rescue of the mutant phenotype, manifest as a pronounced increase in the germ cell population of the seminiferous tubules and survival to the pachytene stage of meiosis. As well as constituting definitive proof of the spermatogenic role of the DAZ gene product, these findings confirmed the high degree of functional conservation between the DAZ and DAZL1 genes, suggesting they may constitute a single target for contraceptive intervention and raising the possibility of therapeutic upregulation of the DAZL1 gene in infertile men.

Another sequence (Lab Designation 7A10_1-rE (SEQ ID NO: 41)) comprises sequence encoding ANNEXIN A2 (ANXA2). This protein is also known ANNEXIN II (ANX2), LIPOCORTIN II; LPC2; LIP2, ANNEXIN II PSEUDOGENE 1, INCLUDED, ANX2P1, INCLUDED ANX2P2, INCLUDED ANX2P3, INCLUDED. This sequence maps to gene map locus 15q21-q22.

Annexin II, a major cellular substrate of the tyrosine kinase encoded by the SRC oncogene (190090), belongs to the annexin family of Ca(2+)-dependent phospholipid- and membrane-binding proteins. By screening a cDNA expression library generated from highly purified human osteoclast-like multinuclear cells (MNC) formed in long-term bone marrow cultures, Takahashi et al. (1994) identified a candidate clone that stimulated MNC formation. Sequence analysis showed that this cDNA encoded annexin II. Further studies yielded results suggesting that ANX2 is an autocrine factor that enhances osteoclast formation and bone resorption, a previously unknown function for this molecule.

Spano et al. (1990) isolated and characterized human genomic clones of the gene encoding lipocortin II (LIP2) and of 3 pseudogenes. The LIP2 gene is at least 40 kb long and consists of 13 exons. The 3 pseudogenes show typical features of retroposons. Spano et al. (1990) reported experiments which, together with the data published by Huebner et al. (1988), led them to conclude that the LIP2 gene is located on chromosome 15. The 3 pseudogenes were assigned to chromosomes 4, 9 and 10. The coexistence on chromosome 9 of the LIP1 gene (151690) and a LIP pseudogene was considered fortuitous. Richard et al. (1994) presented an integration of the physical, expression, and genetic maps of human chromosome 15. They placed the ANXA2 gene in their region IV, i.e., 15q21-q22, thus confirming the previous localization.

PSEUDOGENES By use of cDNAs in somatic cell hybrid analysis and in situ hybridization, Huebner et al. (1987, 1988) mapped the LPC2A (LIP2P1) locus to 4q21-q31. Spano et al. (1990) presented evidence that the lipocortin II-like gene that maps to chromosome 4 is a pseudogene (ANX2P1) with typical features of a retroposon.

By means of a lipocortin cDNA in somatic cell hybrid analysis and in situ chromosome hybridization, Huebner et al. (1987, 1988) mapped LPC2B to chromosome 9. Thus, LPC1 and LPC2B are syntenic. LPC2B is located proximal to ABL (189980). Calpactin I is a synonym for lipocortin II. Spano et al. (1990) presented evidence that the lipocortin II-like gene that maps to chromosome 9 is a pseudogene (ANX2P2) with features typical of a retroposon. The Genome Database (GDB) gave the regional location as 9p13.

Huebner et al. (1987, 1988) mapped the lipocortin IIC (LPC2C) gene to 10q21-q22. According to Spano et al. (1990), the lipocortin II-like gene that maps to chromosome 10 is a pseudogene (ANX2P3) with the structure of a retroposon which is related to the functional lipocortin II gene located on chromosome 15.

Another sequence (Lab Designation 10_46_4-Lac (SEQ ID NO: 214)) comprises sequence encoding DNAJ, *E. COLI*, HOMOLOG OF, SUBFAMILY A, MEMBER 1; DNAJA1. This protein is also known as HEAT-SHOCK PROTEIN, DNAJ-LIKE 2; HSJ2 HEAT-SHOCK 40-KD PROTEIN 4; HSPF4,HDJ2 and HSDJ. Dnaja1 overlaps two other genes: LOC158188 and LOC158187. The gene dnaj1 is also disrupted in present invention. Dnaja1 is off the negative strand.

The *E. coli* heat-shock protein DNAJ has been implicated in protein folding, proteolysis, phosphorylation, and replication of phage. By screening a human umbilical vein endothelial cell cDNA expression library with a monoclonal antibody that reacts specifically with human endothelial cells and monocytes, Chellaiah et al. (1993) isolated cDNAs encoding HSJ2, which they named HDJ2. The predicted 397-amino acid HSJ2 protein is 32% identical to DNAJ, with the highest identity in the N-terminal region. Among the known DNAJ homologs in *S. cerevisiae*, HSJ2 is most identical to YDJ1, which may be involved in the transport of certain proteins into the mitochondria and endoplasmic reticulum.

Another sequence (Lab Designation 12_3B#2_Lac (SEQ ID NO: 218)) comprises JWA which, on the negative strand is next to: UBE1C: ubiquitin-activating enzyme E1C (UBA3 homolog, yeast). Subunit of E1 (ubiquitin-activating enzyme)-like complex; activates NEDD8 and targets Hs-cullin-4A (Cu14A) for degradation ecursor protein-binding protein-1) can bind to NEDD8 in rabbit reticulocyte lysates. However, since APP-BP1 shows similarity to only the N-terminal domain of an E1 enzyme, the authors reasoned that it must interact with a protein showing similarity to the C-terminal region of E1s. By searching sequence databases, Osaka et al. (1998) identified cDNAs encoding UBA3, the human homolog of yeast Uba3. The predicted 442-amino acid UBA3 protein shares 43% sequence identity with yeast Uba3. In vitro, UBA3 formed a complex with APP-BP1 and a thioester linkage with NEDD8. Osaka et al. (1998) suggested that the APP-BP1/UBA3 complex functions as an E1-like enzyme for the activation of NEDD8.

Another sequence (Lab Designation 12_3B#8-rE (SEQ ID NO: 107)) comprises sequence encoding APRATAXIN (APTX). This protein is also known as FLJ20157 This sequence maps to gene map locus 9p13.3.

The APTX gene encodes a member of the histidine triad (HIT) superfamily, to which have been attributed nucleotide-binding and diadenosine polyphosphate hydrolase activities. The APTX gene is mutant in ataxia-ocular apraxia (208920).

Early-onset ataxia with oculomotor apraxia, the ataxia-oculomotor apraxia syndrome (208920), maps to 9p13. Date et al. (2001) identified a group of Japanese patients whose clinical presentation was characterized by autosomal recessive inheritance, early age of onset, Friedreich ataxia (FRDA; 229300)-like clinical presentations, and hypoalbuminemia. Linkage to the FRDA locus was excluded. They confirmed that the disorder in these patients linked to the same locus, 9p13, as the ataxia-oculomotor apraxia syndrome. They narrowed the candidate region and identified a novel gene encoding a member of the histidine triad superfamily as the causative gene. They called its product aprataxin, with the gene symbol APTX. Although many HIT proteins had been identified (e.g., FHIT, 601153; HINT, 601314), aprataxin was the first to be linked to a distinct phenotype.

By homozygosity mapping and study of Portuguese and Japanese founder haplotypes, Moreira et al. (2001) localized the gene mutant in ataxia-oculomotor apraxia syndrome to a 2-cM interval on 9p13.3. They reduced the critical interval to a 300-kb region and identified mutations in the APRX gene, which had been identified as FLJ20157 (GenBank AK000164).

Expression of Alternative Transcripts

Moreira et al. (2001) identified 2 major mRNA species of APTX resulting from alternative splicing of exon 3: a short form of 168 amino acids and the first ATG codon in exon 3, and a long form with an additional 115 nucleotides of the 5-prime portion of exon 3, resulting in the addition of another 174 amino acids and the first codon ATG codon in exon 1. Moreira et al. (2001) and Date et al. (2001) numbered mutations according to both the long and short forms of the transcript.

Moreira et al. (2001) demonstrated by RT-PCR that the APTX gene is ubiquitously expressed. The long transcript is the major form found in human cell lines, with the shorter frame-shifted form present in lower amounts; liver tissue has equal amounts of the 2 transcripts. By Northern blot analysis, Date et al. (2001) demonstrated ubiquitous expression of the 2.2-kb long form and limited expression of the 1.35-kb short form.

Date et al. (2001) showed by homology search that both forms of aprataxin have a highly conserved HIT motif (His-X-His-X-His-X-X, where X is a hydrophobic amino acid), an essential motif for HIT proteins. HIT proteins have been classified into 2 branches: the fragile HIT protein family found only in animals and fungi, and the ancient HIT nucleotide-binding protein (HINT) family that has representatives in all cellular life. Phylogenetic tree analysis showed that aprataxin is the third member of the HIT protein superfamily. The mutations found in patients with early-onset ataxia with oculomotor apraxia and hypoalbuminemia involved highly conserved amino acids.

Date et al. (2001) and Moreira et al. (2001) identified mutations in the APRX gene as the cause of ataxia-oculomotor apraxia. Date et al. (2001) observed that an insertion or deletion mutation resulted in a severe phenotype with childhood onset, whereas missense mutations resulted in a mild phenotype with relatively late age of onset; in their pedigree 2637 with compound heterozygosity for val89-to-gly (606350.0004) and pro32-to-leu (606350.0002), the age of onset was 25 years.

0.0001 ATAXIA, EARLY-ONSET, WITH OCULOMOTOR APRAXIA AND HYPOALBUMINEMIA [APTX, 1-BP INS, 167T] Date et al. (2001) found that affected individuals in 3 pedigrees with EAOH (208920) carried a homozygous insertion of a T after nucleotide 167 (167delT;

nucleotide number starting at the first ATG codon of the short form), which results in a frameshift with a premature stop. Affected individuals in these 3 families were homozygous; in 3 other pedigrees affected members had this mutation in heterozygous state in combination with a different mutation. Among their patients, Moreira et al. (2001) found that the Japanese founding haplotypes were associated with the same mutation, which they called 689insT according to the gene's long transcript.

0.0002 ATAXIA, EARLY-ONSET, WITH OCULOMOTOR APRAXIA AND HYPOALBUMINEMIA [APTX, PRO32LEU] The second most common mutation found by Date et al. (2001) in families with EAOH (208920) was a C-to-T transition resulting in a pro32-to-leu amino acid change. This mutation removes a proline residue that is highly conserved among all the subfamilies of HIT proteins. Moreira et al. (2001) designated this mutation PRO206LEU according to the APTX gene's long transcript.

0.0003 ATAXIA, EARLY-ONSET, WITH OCULOMOTOR APRAXIA AND HYPOALBUMINEMIA [APTX, 1-BP DEL, 318T] In one pedigree, Date et al. (2001) observed that members with EAOH (208920) were homozygous for a 318delT single-nucleotide deletion resulting in a frameshift with a premature stop. In 3 pedigrees, the 167insT (606350.0001), P32L (606350.0002), and 318delT mutations were present in compound heterozygous state.

0.0004 ATAXIA, EARLY-ONSET, WITH OCULOMOTOR APRAXIA AND HYPOALBUMINEMIA [APTX, VAL89GLY] In a family with EAOH (208920), Date et al. (2001) observed that affected members had a val89-to-gly (V89G) missense mutation involving one of the highly conserved hydrophobic amino acids of the histidine triad. As the HIT motif forms part of the phosphate binding loop, the V89G mutation probably affects the phosphate-binding activity.

Another sequence (Lab Designation L195B1E_rE (SEQ ID NO: 138) comprises sequence encoding GENERAL TRANSCRIPTION FACTOR IIE, POLYPEPTIDE 1 (GTF2E1).

Initiation of transcription from eukaryotic protein-coding genes is a complex process requiring RNA polymerase II (PolII; see 180660) and a cadre of transcription factors. These factors can be divided into 2 classes on the basis of their function: the general factors that are required for transcription of all PolII genes, and sequence-specific factors that are required for regulating expression. The general transcription factors and PolII form a specific multiprotein complex near the transcription start site by interacting with core promoter elements. The most common core element is the TATA box, typically located 25-30 bp upstream of the transcriptional start site or initiator element. Sequence-specific transcription factors that bind to DNA-sequence elements located proximal and distal to the core promoter elements can dramatically enhance or repress transcription. The general transcription factors that have been identified are TFIIA, TFIIB (189963), TFIID (313650), TFIIE (see also 189964), TFIIF (189968, 189969), TFIIG/J, and Levi (189972). Human TFIIE consists of 2 subunits of relative molecular masses 56,000 and 34,000. The structure of TFIIE appears to be a heterotetramer of 2 alpha and 2 beta subunits, both subunits being required for optimal reconstituted basal-level transcription. Peterson et al. (1991) isolated human cDNA clones for both subunits of the general transcription factor IIE. Using purified recombinant proteins they found that both subunits are essential to form a stable preinitiation complex and to reconstitute basal-level and Sp1-activated (189906) transcription in vitro. Ohkuma et al. (1991) also cloned the TF2E1 gene and pointed to sequence similarities to bacterial sigma factors, suggesting a direct involvement in the regulation of transcription initiation.

High levels of gene transcription by RNA polymerase II depend on high rates of transcription initiation and reinitiation. Initiation requires recruitment of the complete transcription machinery to a promoter, a process facilitated by activators and chromatin remodeling factors. Reinitiation is thought to occur through a different pathway. After initiation, a subset of the transcription machinery remains at the promoter, forming a platform for assembly of a second transcription complex. Yudkovsky et al. (2000) described the isolation of a reinitiation intermediate in yeast that includes transcription factors TFIID, TFIIA (see 600520), TFIIH, TFIIE, and Mediator (see 602984). This intermediate can act as a scaffold for formation of a functional reinitiation complex. Formation of this scaffold is dependent on ATP and TFIIH. In yeast, the scaffold is stabilized in the presence of the activator Gal4-VP16, but not Gal4-AH, suggesting a new role for some activators and Mediator in promoting high levels of transcription.

Another sequence Lab Designation est_L24__5__3BE_rEa (SEQ ID NO: 359)) comprises sequence encoding TUSP. This sequence maps to gene map locus 6q25-q26.

The mutated gene responsible for the tubby obesity phenotype has been identified by positional cloning (Kleyn et al. "Identification and characterization of the mouse obesity gene tubby: a member of a novel gene family" Cell 85(2): 281-90 Apr. 19, 1996). A single base change within a splice donor site results in the incorrect retention of a single intron in the mature tub mRNA transcript. The consequence of this mutation is the substitution of the carboxy-terminal 44 amino acids with 24 intron-encoded amino acids. The normal transcript appears to be abundantly expressed in the hypothalamus, a region of the brain involved in body weight regulation. Variation in the relative abundance of alternative splice products is observed between inbred mouse strains and appears to correlate with an intron length polymorphism. This allele of tub is a candidate for a previously reported diet-induced obesity quantitative trait locus on mouse chromosome 7.

Another sequence (Lab Designation L191B2E#1 (SEQ ID NO: 85)) comprises sequence encoding REPLICATION PROTEIN A3, 14-KD (RPA3). This protein is also known as RPA14 or REPA3. This sequence maps to gene map locus 7p22.

Umbricht et al. (1993) cloned the 14-kD subunit of human RPA from a HeLa cell cDNA library. The RPA3 gene was found to have a 692-basepair sequence with an open reading frame encoding a protein of 121 amino acids. The deduced amino acid sequence showed only limited similarity to the small subunit of yeast RPA. Using PCR amplification of genomic DNA from rodent-human hybrid cell lines, Umbricht et al. (1993) mapped the human REPA3 gene to chromosome 7. By Southern analysis and PCR amplification of somatic cell hybrids of chromosome 7, as well as by fluorescence in situ hybridization, Umbricht et al. (1994) mapped RPA3 to 7p22. See also RPA1 (179835) and RPA2 (179836).

Another sequence comprises sequence encoding REPLICATION PROTEIN A1, 70-KD (RPA1). This protein is also known as RPA70 or REPA1. This sequence maps to gene map locus 17p13.3.

Replication protein A (RPA) is a 3-subunit single-stranded DNA-binding protein that has been isolated from human cells and found to be essential for in vitro replication of the papovavirus SV40. Erdile et al. (1991) reported the sequence of a cDNA encoding the 70-kD subunit. The human cDNA directed production in E. coli of a 70-kD protein that reacted with a monoclonal antibody directed against the 70-kD subunit of the human protein. The recombinant subunit, purified from bacteria, exhibited single-stranded DNA-binding activity comparable to that of the complete RPA complex. It could substitute for the complete complex in stimulating the activity of DNA polymerase alpha-primase, but could not substitute for the complete complex in SV40 DNA replication in vitro, suggesting an important functional role for the other subunits. Using PCR amplification of genomic DNA from rodent-human cell lines, Umbricht et al. (1993) mapped the gene for the 70-kD subunit to chromosome 17. By the same method, they mapped the genes for the 32-kD (179836) and the 14-kD (179837) subunits to chromosomes 1 and 7, respectively. Using a combination of PCR amplification of somatic cell hybrids and radiation hybrids containing chromosome 17 fragments, Umbricht et al. (1994) mapped RPA1 to 17p13.3.

Gomes and Wold (1996) constructed a series of N-terminal deletions of RPA70 to explore the function of the protein. Their data indicated that RPA70 is composed of 3 functional domains: an N-terminal domain that is not required for single-stranded DNA binding or SV40 replication, a central DNA-binding domain, and a C-terminal domain that is essential for subunit interactions.

A growing body of evidence shows that the folding of mRNA influences a diverse range of biologic events such as mRNA splicing and processing, and translational control and regulation. Because the structure of mRNA is determined by its nucleotide sequence and its environment, Shen et al. (1999) examined whether the folding of mRNA could be influenced by the presence of single-nucleotide polymorphisms (SNPs). They reported marked differences in mRNA secondary structure associated with SNPs in the coding region of 2 human mRNAs: alanyl-tRNA synthetase (601065) and replication protein A, 70-kD subunit. Enzymatic probing of SNP-containing fragments of the mRNAs revealed pronounced allelic differences in cleavage pattern at sites 14 or 18 nucleotides away from the SNP, suggesting that a single-nucleotide variation can give rise to different mRNA folds. By using oligodeoxyribonucleotides complementary to the region of different allelic structures in the RPA70 mRNA, but not extending to the SNP itself, they found that the SNP exerted an allele-specific effect on the accessibility of its flanking site in the endogenous human RPA70 mRNA. The results demonstrated the contribution of common genetic variation through structural diversity of mRNA and suggested a broader role than previously thought for the effects of SNPs on mRNA structure and, ultimately, biologic function.

Nakayama et al. (1999) reported that a −786T-C mutation (163729.0002), in the promoter region of the endothelial nitric oxide synthase (eNOS) gene reduced transcription of the gene and was strongly associated with coronary spastic angina and myocardial infarction. Miyamoto et al. (2000) determined that RPA1 specifically binds to the mutant allele in nuclear extracts from HeLa cells. In human umbilical vein endothelial cells, inhibition of RPA1 expression using antisense oligonucleotides restored transcription driven by the mutated promoter sequence, whereas overexpression of RPA1 further reduced it. Serum nitrite-nitrate levels among individuals carrying the −786T-C mutation were significantly lower than among those without the mutation. The authors concluded that RPA1 apparently functions as a repressor protein in the −786T-C mutation-related reduction of eNOS gene transcription associated with the development of coronary artery disease.

Another sequence (Lab Designation L192B3E#13_rE (SEQ ID NO: 143) comprises sequence encoding INSULIN-LIKE GROWTH FACTOR 2 RECEPTOR (IGF2R). This protein is also known as INSULIN-LIKE GROWTH FACTOR II, RECEPTOR FOR MANNOSE 6-PHOSPHATE RECEPTOR, CATION-INDEPENDENT, MIPR or CIMPR. This sequence maps to gene map locus 6q26.

Insulin-like growth factor II (147470) is a polypeptide hormone with structural homologies to insulin and IGF I. Although IGF II can stimulate a broad range of biologic responses in isolated cells, these responses appear to be mediated by the insulin and IGF I receptors (147670, 147370). The receptor for IGF II was found also to be the receptor for mannose 6-phosphate, which is implicated in targeting of lysosomal enzymes (MacDonald et al., 1988; Roth, 1988; Tong et al., 1988). Purified human and rat IGF2 receptors interact with antibodies to the mannose 6-phosphate receptor and with mannose 6-phosphate. Oshima et al. (1988) cloned and sequenced the full-length cDNA for MPRI; 7,473 nucleotides were found to encode a protein of 2,491 amino acids. The amino acid sequence included a putative signal sequence of 40 amino acids and an extra cytoplasmic domain consisting of 15 homologous repeat sequences of 134 to 167 amino acids, a transmembrane region of 23 amino acids, and a cytoplasmic domain of 164 amino acids. The predicted molecular size was greater than 270 kD. On comparison to the reported structure of IGF2R (Morgan et al., 1987), MPR1 was found to show 99.8% identity at the nucleotide level and 99.4% identity at the amino acid level. By cDNA sequencing, Laureys et al. (1988) showed that the cation-independent mannose 6-phosphate receptor and IGF2 receptor are identical.

Szebeny and Rotwein (1994) cloned and characterized the mouse Igf2r gene. They found that it is 93 kb long, with 48 exons, and encodes a predicted protein of 2,482 amino acids.

Laureys et al. (1988) mapped the human IGF2R gene to 6q25-q27, using cloned cDNAs to probe Southern blots of somatic cell hybrid DNA and for in situ chromosomal hybridization. The corresponding mouse gene mapped to chromosome 17. The cation-dependent mannose 6-phosphate receptor (MPRD; 154540) is coded by chromosome 12. By fluorescence in situ hybridization, Rao et al. (1994) narrowed the assignment of the IGF2R gene to 6q26.

Acquati et al. (1994) described a 2-Mb YAC from the telomeric region of 6q containing the plasminogen-apolipoprotein(a) gene family at its centromeric end and IGF2R at the telomeric end. About 350 kb separated IGF2R from the nearest member of the PLG/LPA cluster of genes.

Mutation in either MPRD or MPRI might result in a clinical disorder resembling a mucolipidosis (252500, 252600). Waheed et al. (1988) showed that the M6P and IGF2 binding sites are located on different segments of the receptor. Kiess et al. (1988) presented biochemical evidence that the IGF2 receptor and the cation-independent mannose 6-phosphate receptor are the same protein but that the binding sites for the 2 ligands are distinct. In its guise as a mannose 6-phosphate receptor, the IGF2 receptor binds mannose 6-phosphate residues on lysosomal enzymes and transports them into lysosomes (Kornfeld and Mellman, 1989).

Mouse embryos produce transcripts of the type II receptor from the maternal chromosome but not from the paternal. This could explain why mice that are heterozygous for deletions of the locus develop normally if their paternal allele is missing but die during early development if the maternal allele is missing. Studies in transgenic mice (Barlow et al., 1991) show parental imprinting, i.e., monoallelic expression, of the Igf2r gene. The Igf2r gene maps to the T-associated maternal effect locus (Tme) on mouse chromosome 17. It is probably no coincidence that the IGF2 gene and the gene for its type 2 receptor are oppositely imprinted (DeChiara et al., 1991). Haig and Graham (1991) proposed that the oppositely imprinted genes function to control the ultimately adverse effects of excessive production of IGF2 from the maternal allele. The suggestion is based on the model of *Haig and Westoby* (1989) which proposes that the evolution of genomic imprinting is expected in organisms that have both a breeding system in which females carry offspring by more than one male during their life span and a system of parental care in which offspring receive most of their postfertilization nutrients from 1 parent (usually the mother) and thus compete with offspring fathered by other males. Strictly, imprinting is possible whenever an individual's interactions are asymmetric with respect to maternal- and paternal-side relatives.

Although in mice the M6P/IGF2R gene is maternally imprinted (Barlow et al. 1991), in humans imprinting appears to be a polymorphic trait (Xu et al. 1993; Kalscheuer et al. 1993; Ogawa et al. 1993). Thus, mice and any humans who are imprinted may have an increased susceptibility to hepatocellular carcinoma since only 1 mutation would be required to render the gene inactive. De Souza et al. (1995) noted that, since the M6P/IGF2R protein is normally present in the circulation, mutant receptors in the plasma might be helpful in liver tumor detection. Furthermore, they stated that mutated receptors on the plasma membrane of liver tumor cells might provide a surface antigen for the targeting of both therapeutic and diagnostic agents to liver tumors.

The serine proteinase granzyme B (GZMB; 123910) is crucial for the rapid induction of target cell apoptosis by cytotoxic T cells. GZMB enters cells in a perforin-independent manner, predicting the existence of a cell surface receptor(s). Motyka et al. (2000) presented evidence that this receptor is IGF2R. Inhibition of the GZMB-IGF2R interaction prevented GZMB cell surface binding, uptake, and the induction of apoptosis. Significantly, expression of IGF2R was essential for cytotoxic T cell-mediated apoptosis of target cells in vitro and for the rejection of allogeneic cells in vivo.

The cytosolic tails of both the cation-independent and the cation-dependent (154540) mannose 6-phosphate receptors contain acidic cluster-dileucine signals that direct sorting from the trans-Golgi network to the endosomal-lysosomal system. Puertollano et al. (2001) found that these signals bind to the VHS domain of the Golgi-localized, gamma-ear-containing, ARF-binding proteins (GGA1, 606004; GGA2, 606005; GGA3, 606006). The receptors and the GGAs left the trans-Golgi network on the same tubulovesicular carriers. A dominant-negative GGA mutant blocked exit of the receptors from the trans-Golgi network. Puertollano et al. (2001) concluded that the GGAs appear to mediate sorting of the mannose 6-phosphate receptors to the trans-Golgi network.

Zhu et al. (2001) found that the VHS domain of GGA2 binds the acidic cluster-dileucine motif in the cytoplasmic tail of the cation-independent mannose 6-phosphate receptor. Receptors with mutations in this motif were defective in lysosomal enzyme sorting. The hinge domain of GGA2 bound clathrin, suggesting that GGA2 could be a link between cargo molecules and clathrin-coated vesicle assembly. Thus, Zhu et al. (2001) concluded that GGA2 binding to the cation-independent mannose 6-phosphate receptor is important for lysosomal enzyme targeting.

Livestock cloning and in vitro embryo culture have been adversely affected by the exceptional size of some resulting lambs and calves. Multiple abnormalities associated with 'large offspring syndrome' (LOS) limit application of these technologies. Similar fetal overgrowth in humans and mice can result from altered expression of several imprinted genes that are expressed only from 1 parental allele, including IGF2R. Cloning or nonphysiologic embryo culture environments may result in inappropriate epigenetic modification of imprinted genes during early embryogenesis, when many allele-specific imprints are established or maintained. Young et al. (2001) demonstrated reduced fetal methylation and expression of sheep IGF2R, suggesting that preimplantation embryo procedures may be vulnerable to epigenetic alterations in imprinted genes. This highlighted the potential benefits of epigenetic diagnostic screening in developing embryo procedures.

A bidirectional silencer for a 400-kb region that contains 3 imprinted, maternally expressed protein-coding genes (IGF2R; SLC22A2, 602608; SLC22A3, 604842) has been shown by targeted deletion to be located in a sequence of 3.7 kb, which also contains the promoter for the imprinted, paternally expressed noncoding Air RNA (604893). Expression of Air is correlated with repression of all 3 genes on the paternal allele; however, Air RNA overlaps just 1 of these genes in an antisense orientation. By inserting a polyadenylation signal that truncates 96% of the RNA transcript, Sleutels et al. (2002) demonstrated that Air RNA is required for silencing. The truncated Air allele maintains imprinted expression and methylation of the Air promoter, but shows complete loss of silencing of the IGF2R/SLC22A2/SLC22A3 gene cluster on the paternal chromosome. Sleutels et al. (2002) concluded that noncoding RNAs have an active role in genomic imprinting.

The mannose 6-phosphate/insulin-like growth factor II receptor functions in the intracellular trafficking of lysosomal enzymes, the activation of the potent growth inhibitor, transforming growth factor beta, and the degradation of IGF2, a mitogen often overproduced in tumors. De Souza et al. (1995) demonstrated that 70% of human hepatocellular tumors have loss of heterozygosity (LOH) at the M6P/IGF2R locus at 6q26. In a separate report, De Souza et al. (1995) described a mutation screen that identified point mutations in the remaining allele of 25% of human hepatocellular carcinomas with LOH. One mutation created an alternative splice site within an intron (corresponding to intron 40 in mouse) and resulted in a truncated receptor; 2 others (147280.0001, 147280.0002) gave rise to significant amino acid substitutions. These mutations provided evidence to the authors that the M6P/IGF2R gene functions as a tumor suppressor in human liver carcinogenesis.

Souza et al. (1996) reported that the IGF2R gene contains a number of microsatellite repeats within its coding sequence. They demonstrated microsatellite instability in this gene in 12 of 92 gastrointestinal tumors studied which were replication/repair error-positive. Mutations occurred in 6 of the poorly differentiated tumors. They noted an anticorrespondence of IGF2R and TGFBR2 (190182) mutations. Of 31 gastrointestinal lesions studied with IGF2R or TGFBR2 mutations, 90% (28) contained mutations in one or the other, but not both, of these genes. Souza et al. (1996) demonstrated that all but 1 of the mutations occurred within an 8-polydeoxyguanine tract spanning nucleotides 4089-4096 of the IGF2R coding sequence. In 1 case of gastric adenocarcinoma, mutation occurred in a polyCT tract spanning nucleotides 6169-6180. These mutations all comprised 1- or 2-bp deletions or insertions within the microsatellite region, causing frameshifts and premature stop codons downstream. Souza et al. (1996) noted that the TGFBR2 gene is also subject to microsatellite instability within its coding region. They noted further that IGF2R and TGFBR2 genes comprise serial points in the same tumorigenesis pathway, since mutation of either gene alone occurred in 90% of the gastrointestinal tumors that they analyzed.

To facilitate genetic analyses of the imprint status of human M6P/IGF2R and loss of heterozygosity at this locus in cancer, Killian et al. (2001) screened American and Japanese populations for M6P/IGF2R single nucleotide polymorphisms (SNPs). They identified 9 novel intragenic SNPs and 3 amino acid variants in the ligand-binding domains of M6P/IGF2R that may be under selection in humans.

To determine whether paternal expression of the Igf2r gene is necessary for early development in the mouse, Lau et al. (1994) derived mice in which the gene had been disrupted by targeted mutagenesis in embryonic stem (ES) cells with the subsequent introduction of the mutation into the germline of mice. Lau et al. (1994) found that murine embryos that inherit a nonfunctional Igf2r gene from their father are viable and develop normally into adults; however, most mice inheriting the same mutated allele from their mothers die around the time of birth as a consequence of major cardiac abnormalities. The mice that inherit the mutant allele from their mothers do not express Igf2r in their tissues, are 25 to 30% larger than their normal sibs, have elevated levels of circulating IGF2 and IGF-binding proteins, and exhibit a slight kink in the tail. The findings of overgrowth may support the suggestion that relaxation of maternal imprinting of IGF2 plays a role in the features of Beckwith-Wiedemann syndrome (130650) (Feinberg 1993).

Allelic Variants (Selected Examples)

0.0001 Hepatocellular Carcinoma, Somatic [IGF2R, GLY1449VAL]

De Souza et al. (1995) found a C-to-A transversion in 1 allele of the IGF2R gene creating a gly1449-to-val amino acid substitution in the gene product. This mutation was found in a tumor which showed deletion of the other allele as judged by loss of heterozygosity (LOH).

0.0002 Hepatocellular Carcinoma, Somatic [IGF2R, GLY1464GLU]

De Souza et al. (1995) found a G-to-A transition in 1 allele of the IGF2R gene creating a gly1464-to-glu amino acid substitution in the gene product. This mutation was found in a tumor which showed deletion of the other allele as judged by loss of heterozygosity (LOH).

Another sequence (Lab Designation L24_4_2BE_rE (SEQ ID NO: 200)) comprises sequence encoding DISTAL-LESS HOMEO BOX 2 (DLX2). This protein is also known as TES 1 and the sequence maps to gene map locus 2q32

To isolate genes involved in forebrain development, Porteus et al. (1992) used subtractive hybridization of cDNA libraries to enrich for cDNAs that are encoded by genes preferentially expressed in mouse gestational day 15 telencephalon. In an attempt to find genes that are candidates for the regulation of forebrain development, the subtracted cDNA library was screened with probes homologous to the homeo box, a conserved motif found in transcriptional regulators that often control development. A novel cDNA, named Tes1, that encodes a homeodomain was identified. Its sequence showed that Tes1 was a member of the 'Distal-less' family of homeodomain-encoding genes. Related by amino acid homology within their homeodomains, the known members of the family are Tes1, Dlx1 (a mouse gene), and Dll (a *Drosophila melanogaster* gene). Ozcelik et al. (1992) determined the chromosomal location of the Tes1 gene in mouse and human. Because Tes1 is a member of the Dlx gene family, the gene symbol for this locus was established as DLX2 (human) and Dlx2 (mouse). By Southern analysis of somatic cell hybrid lines, they assigned the human locus to chromosome 2cen-q33 and the mouse locus to chromosome 2. An EcoRI dimorphism was used for recombinant inbred strain mapping in the mouse. The results placed the Dlx2 gene near the Hox4 cluster on mouse chromosome 2.

Qiu et al. (1995) utilized information about the genomic structure of the murine Dlx2 gene to carry out gene targeting experiments and made deletions in the Dlx2 gene in mouse embryonic stem cells for use in transgenic mice. They reported that heterozygous mice appeared normal and homozygous mice died on the day of birth. The mutant mice had altered differentiation of interneurons in the olfactory bulb and abnormal morphogenesis of the cranial neural crest-derived skeletal structures formed from the proximal first and second branchial arches, causing cleft palate.

McGuinness et al. (1996) reported the DNA sequence of the human DLX2 gene and compared this to the murine gene. Analysis of the sequence indicated that the human DLX2 gene has 3 exons and 2 introns. The deduced sequence of the human DLX2 protein shows that the human and mouse DLX2 proteins are 92% identical. The human DLX2 protein is 330 amino acids in length, while the mouse DLX2 protein contains 332 amino acids. The introns have 63 to 71% identity. Domains identified in the human and mouse DLX2 gene include a homeodomain and short stretches of homology to several transcription factors. McGuinness et al. (1996) noted that availability of the sequence of the human DLX2 gene will facilitate the use of PCR analysis for screening for human mutations in DLX2 in abnormal development.

Another sequence (Lab Designation seq1b_lac (SEQ ID NO: 267) comprises sequence encoding ZINC FINGER PROTEIN 7 (ZNF7). This protein is also known as KOX4. This sequence maps to gene map locus 8q24

On the basis of sequence similarity in the repeated zinc finger domain, Lania et al. (1990) identified and characterized 2 human cDNA clones, designated ZNF7 and ZNF8, both of which encoded proteins containing potential finger-like nucleic acid binding motifs. The predicted 686-amino acid ZNF7 protein contains 15 zinc finger domains that comprise nearly 70% of the protein. Northern blot analysis revealed that ZNF7 is expressed as 2.8- and 3,3-kb mRNAs in a variety of human cell lines.

By in situ hybridization, Lania et al. (1990) localized ZNF7 to 8q24 and ZNF8 to 20q13. Bray et al. (1991) likewise mapped ZNF7 to 8qter by chromosomal in situ suppression hybridization with fluorescent probe detection. Bray et al. (1991) determined that the genomic locus designated ZNF7 corresponds to KOX4 in the set of 30 zinc finger protein-encoding cDNAs (KOX1-KOX30) previously isolated from a T-cell library (Thiesen, 1990). They concluded that the human genome contains many, probably several hundred, zinc finger genes with consensus his/cys (H/C) link regions. Huebner et al. (1993) confirmed the assignment of ZNF7 to 8q24 by analysis of rodent/human somatic cell hybrids and by in situ hybridization. They showed that ZNF7 is telomeric to the MYC locus (190080).

Another sequence (Lab Designation L197B3E-rE (SEQ ID NO: 135))comprises sequence encoding BCL2-LIKE 1 (BCL2L1).

Boise et al. (1993) isolated a BCL2-related gene, which they designated BCLX, and showed that it can function as a BCL2-independent regulator of programmed cell death (apoptosis). Alternative splicing resulted in 2 distinct BCLX mRNAs. The protein product of the larger mRNA (BCLXL) was similar in size and predicted structure to BCL2. When stably transfected into an IL3-dependent cell line, it inhibited cell death upon growth factor withdrawal at least as well as BCL2. Unexpectedly, the smaller mRNA species (BCLXS)

encodes a protein that inhibits the ability of BCL2 to enhance the survival of growth factor-deprived cells. In vivo, the smaller BCLX mRNA was expressed at high levels in cells that undergo a high rate of turnover, such as developing lymphocytes. In contrast, the large form of BCLX was found in tissues containing long-lived postmitotic cells, such as adult brain. Together these data suggested that BCLX plays an important role in both positive and negative regulation of programmed cell death. Boise et al. (1993) found that BCLX is highly conserved in vertebrate evolution. Vander Heiden et al. (1997) observed in Jurkat cells that a wide variety of apoptotic and necrotic stimuli induce progressive mitochondrial swelling and outer mitochondrial membrane rupture. Discontinuity of the outer mitochondrial membrane results in cytochrome c redistribution from the intermembrane space to the cytosol, followed by subsequent inner mitochondrial membrane depolarization. The mitochondrial membrane protein BCLX could inhibit these changes in cells treated with apoptotic stimuli. In addition, BCLX-expressing cells adapt to growth factor withdrawal or staurosporine treatment by maintaining a decreased mitochondrial membrane potential. BCLX expression also prevents mitochondrial swelling in response to agents that inhibit oxidative phosphorylation. These data suggested to Vander Heiden et al. (1997) that BCLX promotes cell survival by regulating the electrical and osmotic homeostasis of mitochondria.

Silva et al. (1998) found that erythroid cells from patients with polycythemia vera (263300) survived in vitro without erythropoietin. This finding correlated with the expression of BCLX protein, even in mature erythroblasts that normally do not express BCLX. The large BCLX mRNA was the predominant form detected in the erythropoietin-independent erythroid cells. They concluded that deregulated expression of BCLX may contribute to the erythropoietin-independent survival of erythroid-lineage cells in polycythemia vera and thereby contribute to the pathogenesis of this disorder. Moliterno et al. (1998) simultaneously reported impaired expression of the thrombopoietin receptor (MPL; 159530) by platelets from patients with polycythemia vera.

During transduction of an apoptotic signal into the cell, there is an alteration in the permeability of the membranes of the cell's mitochondria, which causes the translocation of the apoptogenic protein cytochrome c into the cytoplasm, which in turn activates death-driving proteolytic proteins known as caspases (see 147678). The BCL2 family of proteins, whose members may be antiapoptotic or proapoptotic, regulates cell death by controlling this mitochondrial membrane permeability during apoptosis. Shimizu et al. (1999) created liposomes that carried the mitochondrial porin channel VDAC (604492) to show that the recombinant proapoptotic proteins Bax (600040) and Bak (600516) accelerate the opening of VDAC, whereas the antiapoptotic protein BCLXL closes VDAC by binding to it directly. Bax and Bak allow cytochrome c to pass through VDAC out of liposomes, but passage is prevented by BCIXL. In agreement with this, VDAC1-deficient mitochondria from a mutant yeast did not exhibit a Bax/Bak-induced loss in membrane potential and cytochrome c release, both of which were inhibited by BCLXL. Shimizu et al. (1999) concluded that the BCL2 family of proteins bind to the VDAC in order to regulate the mitochondrial membrane potential and the release of cytochrome c during apoptosis.

FUS-associated proteins and TLS appear to be the same; Uranishi et al. ("Involvement of the pro-oncoprotein TLS (translocated in liposarcoma) in nuclear factor-kappa B p65-mediated transcription as a coactivator" *J Biol Chem* 20; 276(16):13395-401, April 2001) demonstrate that translocated in liposarcoma (TLS), also termed FUS, is an interacting molecule of the p65 (RelA) subunit of the transcription factor nuclear factor kappaB (NF-kappaB) using a yeast two-hybrid screen. We confirmed the interaction between TLS and p65 by the pull-down assay in vitro and by a coimmunoprecipitation experiment followed by Western blot of the cultured cell in vivo. TLS was originally identified as part of a fusion protein with CHOP arising from chromosomal translocation in human myxoid liposarcomas. TLS has been shown to be involved in TFIID complex formation and associated with RNA polymerase II. However, the role of TLS in transcriptional regulation has not yet been clearly elucidated. We found that TLS enhanced the NF-kappaB-mediated transactivation induced by physiological stimuli such as tumor necrosis factor alpha, interleukin-1beta, and overexpression of NF-kappaB-inducing kinase. TLS augmented NF-kappaB-dependent promoter activity of the intercellular adhesion molecule-1 gene and interferon-beta gene. These results suggest that TLS acts as a coactivator of NF-kappaB and plays a pivotal role in the NF-kappaB-mediated transactivation.

A group of evolutionarily conserved pleiotropic COP/DET/FUS proteins was initially defined by their ability to repress photomorphogenesis in *Arabidopsis* (Suzuki et al. "*Arabidopsis* COP10 is a ubiquitin-conjugating enzyme variant that acts together with COP1 and the COP9 signalosome in repressing photomorphogenesis" Genes Dev 16(5):554-9, Mar. 1, 2002). It was proposed that this regulation be mediated by targeting degradation of key cellular regulators that promote photomorphogenesis. Among them, COP1 and the COP9 signalosome have been hypothesized to fulfill the roles as an ubiquitin ligase (E3) and an essential E3 modulator. Here we report that COP10 encodes a protein similar to ubiquitin-conjugating enzyme (E2) variant proteins (U1EV). COP10 is part of a nuclear protein complex and capable of directly interacting with both COP1 and the COP9 signalosome. Our data indicates that COP10 defines a possible E2 activity, thus validating the working hypothesis that the pleiotropic COP/DET/FUS group of proteins defined a protein ubiquidnation pathway.

Another sequence (Lab Designation 8C5_6_rE (SEQ ID NO: 46)) comprises sequence encoding AMIOPEPTIDASE, PUROMYCIN-SENSITIVE (NPEPPS). This protein is also known as PSA and METALLOPROTEASE MP100(MP 100). This sequence maps to gene map locus 17q21

Aminopeptidases are a group of exopeptidases that hydrolyze amino acids from the N terminus of a peptide substrate. Puromycin-sensitive aminopeptidase (EC 3.4.11.14) contains the zinc-binding domain characteristic of the gluzincin group of zinc metalloproteases (see 605896).

Tobler et al. (1997) cloned PSA from a human fetal brain cDNA library using the mouse PSA cDNA as probe. They established that translation is initiated at the second of 2 possible start codons, resulting in a deduced 875-amino acid protein with a molecular mass of 99 kD by SDS-PAGE. PSA contains a zinc-binding motif conserved among gluzincin aminopeptidases and shares 98% sequence identity with the mouse protein. Northern blot analysis detected ubiquitous expression of a 4.8-kb transcript, with highest expression in brain. By in situ hybridization of adult human brain sections, expression was localized to the perikaryon of neurons of the cortex and cerebellum. Using immunofluorescence localization of transfected HeLa cells, Tobler et al. (1997) found that PSA localizes to the perinuclear cytoplasm and shows a filamentous staining pattern. Bauer et al. (2001) cloned PSA cDNA from a human skeletal muscle library. Northern blot analysis detected major and minor transcripts of 4.8 and 4.2 kb, respectively. Huber et al. (1999) determined that PSA is identical to the matalloprotease MP100 that was originally isolated as a beta-secretase candidate from human brain by Schonlein et al. (1994).

Huber et al. (1999) were able to colocalize and coimmunoprecipitate PSA with beta-amyloid precursor protein (104760); however, PSA did not increase production of the amyloid-beta peptide in cotransfected cells. By RT-PCR, but not by Northern blot analysis, Bauer et al. (2001) found that PSA was upregulated in human leukemic cells following vitamin D stimulation.

Thompson et al. (1999) determined that the PSA gene contains 23 exons spanning approximately 40 kb. They found that the active site motif is split between exons 9 and 10. Analysis of the 5-prime flanking region indicated that the gene lacks a TATA box, is GC rich, and contains 5 putative SP1 (189906)-binding sites.

By FISH, Bauer et al. (2001) mapped the PSA gene to chromosome 17q21. Osada et al. (1999) mapped the mouse Psa gene to a region of syntenic homology on chromosome 11.

Another sequence (Lab Designation 70A_rE (SEQ ID NO: 188)) comprises sequence encoding ANNEXIN A3 (ANXA3). This protein is also known as ANNEXIN III (ANX3) and as LIPOCORTIN m. This sequence maps to gene map locus 4q21.

The annexins are a family of calcium-dependent phospholipid-binding proteins. The family consists of at least 10 distinct members, each of which contains 4 or 8 copies of an 80-amino acid repeating unit first identified in lipocortin/annexin I. Annexin III was previously identified as inositol 1,2-cyclic phosphate 2-phosphohydrolase (EC 3.1.4.36), an enzyme of inositol phosphate metabolism, and also as placental anticoagulant protein III, lipocortin III, calcimedin 35-alpha, and an abundant neutrophil cytoplasmic protein. The mature annexin III protein contains 322 amino acids and, like other annexins, consists primarily of 4 copies of a 70- to 80-amino acid repeat unit. Characterizing the gene from directly amplified genomic DNA and from 6 genomic clones in phage lambda, Tait et al., (1993) determined that the transcribed region spans 58 kb and contains 12 introns ranging from 0.3 to 19.1 kb and 13 exons ranging from 53 to 374 bases. Northern blot showed a single mRNA species with approximately 1.67 kb in all tissues examined.

Tait et al. (1991) localized the ANXA3 gene to 4q21 (q13-q22) by PCR analysis of a human-rodent hybrid cell panel, confirmed by genomic Southern blot analysis of the same panel with a cDNA probe, and by in situ hybridization with a cDNA probe.

Another sequence (Lab Designation 6BSA#12-rE (SEQ ID NO: 39) comprises sequence encoding ADAM 10. This sequence maps to human chromosomal location 15q21.3-q2.

Lunn et al. ("Purification of ADAM 10 from bovine spleen as a TNFalpha convertase" FEBS Lett 400(3):333-5, Jan. 6, 1997) purified a protease with characteristics of TNFalpha convertase from bovine spleen membranes. Peptide sequencing of the purified protein identified it as ADAM 10 (Genbank accession no. Z21961). This metalloprotease cleaves a recombinant proTNFalpha substrate to mature TNFalpha, and can cleave a synthetic peptide substrate to yield the mature TNFalpha amino terminus in vitro. The enzyme is sensitive to a hydroxamate inhibitor of MMPs, but insensitive to phosphoramidon. In addition, cloned ADAM 10 mediates proTNFalpha processing in a processing-incompetent cell line.

Lab Designation 6b65 is a rearranged vector—the tag site may be in ptpl1, sequence is in abcr (abca4—which is not expressed in the parent cell or mutant) and maps to chromosomal location 1p22.1-p21. We have disrupted other rho related genes. PTPL1-associated RhoGAP 1, a GTPase activating protein; activates members of the Rho subfamily of ras-related GTP binding proteins; has a cysteine rich domain Another sequence (Lab Designation 4AE5_rE (SEQ ID NO: 64)) comprises sequence encoding MEMBRANE-SPANNING 4-DOMAINS, SUBFAMILY A, MEMBER 8B (MS4A8B). This sequence maps to gene map locus 11q12-q13.

MS4A family proteins share structural similarity, amino acid sequence homology, and chromosomal location. They contain 4 highly conserved transmembrane domains, flanked by N- and C-terminal cytoplasmic regions.

By database searching for homologs of CD20 (MS4A1; 112210), Liang and Tedderi (2001) obtained a cDNA encoding MS4A8B. The predicted 250-amino acid protein is 63% identical to its mouse homolog. PCR analysis detected weak expression of MS4A8B in cDNA from 3 B-cell lines.

By genomic sequence analysis, Liang and Tedder (2001) mapped the MS4A8B gene to chromosome 11q12-q13, in the same region as MS4A2 (147138) and MS4A3 (606498).

Rho GTPases play a fundamental role in numerous cellular processes that are initiated by extracellular stimuli that work through G protein coupled receptors. The encoded protein may form complex with G proteins and stimulate Rho-dependent signals. This protein is similar to the NET1A protein.

Rho guanine nucleotide exchange factor 3 (RhoGEF); may function in signaling cascades Another sequence (Lab Designation 42_8#3_rE (SEQ ID NO: 324)) comprises sequence encoding ARHGEF3. This sequence maps to gene map locus 3p21-p13.

RhoGEFs play an important role in various signaling cascades and are implicated in human conditions like cancer and mental retardation (Thiesen et al. "Isolation of two novel human RhoGEFs, ARHGEF3 and ARHGEF4, in 3p 13-21 and 2q22" Biochem Biophys Res Commun; 273(1):364-9, Jun. 24, 2000). A database search combined with screening of a human neuronal teratocarcinoma library identified two novel RhoGEFs, ARHGEF3 and ARHGEF4 (HGMW-approved symbols). The widely expressed ARHGEF3 transcript of 3561 nucleotides encodes a polypeptide of 526 amino acids with homology to NET1. The ARHGEF4 gene generates two transcripts of 3665 and 4000 nucleotides that translate into 720 amino acid residues. Expression of ARHGEF4 is restricted to brain and the encoded protein shows homology to collybistin. FISH analysis of genomic clones mapped ARHGEF3 to 3p13-21 and ARHGEF4 to 2q22. Copyright 2000 Academic Press.

Another sequence (Lab Designation 34X25_23_rE (SEQ ID NO: 153)) comprises sequence encoding PHOSPHODIESTERASE 4B, cAMP-SPECIFIC (PDE4B); murine chr 4 2377737 . . . 2727820. This protein is also known as DUNCE-LIKE PHOSPHODIESTERASE E4, FORMERLY; DPDE4. This sequence maps to gene map locus 1p31.

Using RNA from a human lymphocytic B-cell line and a rat PDE IV member B probe, Obernolte et al. (1993) isolated a 3.8-kb cDNA. A single large open reading frame predicted a 564-amino acid protein with 92.9% identity to rat Pde4b; at the nucleotide level, the identity was 86.3%. They determined that a related cDNA clone isolated from human monocytes by Livi et al. (1990) was the human homolog of rat Pde4a (600126). Southern blot analysis indicated that distinct genes encode these 2 PDE IV family members.

Huston et al. (1997) cloned a novel human (plus its cognate rat) PDE4B splice variant and compared its activities to the 2 other splice variants from this locus. Alternative splicing of mRNA generated from both the human and rat PDE4B genes produced long and short splice variants that had unique N-terminal regions. It was suggested that these alternatively spliced regions determined changes in the maximal catalytic activity of the isoforms, their susceptibility to inhibition by rolipram, and mode of interaction with particulate fractions.

Milatovich et al. (1994) mapped the PDE4B gene to human 1p31 by a combination of Southern analysis of somatic cell hybrid lines and fluorescence in situ hybridization (FISH); they assigned the mouse homolog to chromosome 4 by Southern analysis of recombinant inbred (RI) mouse strains. Through the use of somatic cell hybrids segregating either human or rat chromosomes, Szpirer et al. (1995) mapped the PDE4B gene to human chromosome 1 and rat chromosome 5.

Xu et al. (2000) determined the 3-dimensional structure of the catalytic domain of phosphodiesterase 4B2B to 1.77-angstrom resolution. The active site was identified and contains a cluster of 2 metal atoms. Xu et al. (2000) concluded that the structure suggests the mechanism of action and basis for specificity, and will provide a framework for structure-assisted drug design for members of the phosphodiesterase family.

Gale et al. describe the pharmacokinetic and pharmacodynamic profile following oral administration of the phosphodiesterase (PDE)4 inhibitor V11294A in healthy volunteers (Br J Clin Pharmacol 2002 November; 54(5):478-84). Their aim was to assess the pharmacokinetic and pharmacodynamic profile of the novel PDE4 inhibitor V11294A (3-(3-cyclopentyloxy-4-methoxybenzyl)-6-ethylamino-8-isopropyl-3H purine hydrochloride) in healthy male volunteers. METHODS: This was a double-blind, single dose, randomized crossover study in eight healthy volunteers who received a single oral, fasting dose of V11294A (300 mg) or placebo. Blood samples were taken before and 0.5, 1, 2, 2.5, 3, 4, 6, 9, 12, 18 and 24 h after oral dosing for determination of plasma concentrations of V11294A. Blood samples were also taken before and 3 and 24 h after dosing for the assessment of the effect of V11294A on mononuclear cell proliferation and tumour necrosis factor (TNF) release in whole blood. RESULTS: Following a single oral dose of 300 mg V11294A, plasma concentrations of V11294A and its active metabolite V10332 reached Cmax (ng ml−1; mean +/− s.d.; 1398+/−298, 1000+/−400, respectively) after 2.63+/−0.79 and 5.9+/−2.3 h, respectively. For V11294A and V10332, t½ were 9.7+/−3.9 and 9.5+/−1.7 h, and AUC(0, infinity) were 18100+/−6100 and 18600+/−8500 ng ml−1 h, respectively. At 3 h dosing, plasma concentrations of V11294A and V10332 (3-(3-cyclopentyloxy-4-methoxy-benzyl)-8-isopropyl-3H-purin-6-ylamine) were 1300+/−330 and 860+/−300 ng ml-1, 7 and 3 times their in vitro IC50s for inhibition of TNF release and proliferation, respectively. Treatment with V11294A resulted in a significant reduction of lipopolysaccharide (LPS)-induced TNF release at 3 h ($P \ll 0.001$) and at 24 h ($P \ll 0.05$) post ingestion. The amount of TNF released (pmol ml−1) in response to a submaximal concentration of LPS (4 ng ml−1) was not significantly altered following placebo treatment (before 681+/−68 vs 3 h postdose 773+/−109, P=0.27). In contrast, there was a significant reduction in the amount of TNF released following treatment with V11294A (before 778+/−87 vs 3 h postdose 566+/−72, P=0.02). Phytohaemagluttinin (PHA) stimulated the incorporation of [3H]-thymidine in whole blood prior to drug administration. V11294A inhibited the PHA-induced proliferation at 3 h ($P \ll 0.05$). No adverse reactions were noted following single oral administration of V11294A. CONCLUSIONS: A single oral 300 mg dose of V11294A administered to healthy volunteers results in plasma concentrations adequate to inhibit activation of inflammatory cells ex vivo, which persists for at least 24 h without any adverse reactions.

Another sequence comprises sequence encoding GLUCOCORTICOID RECEPTOR (GCCR). This sequence maps to gene map locus 5q31

Vingerhoeds et al. (1976) reported a case of cortisol resistance. High levels of cortisol (without stigmata of Cushing syndrome), resistance of the hypothalamic-pituitary-adrenal axis to dexamethasone, and an affinity defect of the glucocorticoid receptor characterized the disorder. Chrousos et al. (1982) restudied the family reported by Vingerhoeds et al. (1976). A man who was presumably homozygous had mineralocorticoid excess resulting in hypertension, hypokalemia, and metabolic alkalosis. One of his brothers, who had severe hypertension and died of a cerebrovascular accident at age 54, may also have been homozygous. Another brother and his son were apparently heterozygous; they showed slightly elevated 24-hour mean plasma cortisol levels and increased urinary free cortisol. Lipsett et al. (1986) provided further follow-up on the 4-generation family originally reported by Vingerhoeds et al. (1976). Autosomal dominant inheritance of glucocorticoid resistance was clearly demonstrated. Lipsett et al. (1986) believed that a mutation in the glucocorticoid receptor was responsible, although other explanations could be invoked. The single homozygote in the family was the proband; the other persons with elevated plasma cortisol levels and increased urinary free cortisol represented heterozygotes. The parents of the proband descended from families with consanguinity that occurred before the 16th century. The 2 parental families had lived in close proximity for many generations. This cortisol resistance is probably the rarest cause of treatable hypertension yet described. Affected mother and son with decreased glucocorticoid receptors were reported by Iida et al. (1985).

Bronnegard et al. (1986) described a woman with receptor-mediated resistance to cortisol as indicated by elevated 24-hour mean plasma cortisol levels and increased free urinary cortisol. Plasma ACTH concentrations were normal but she was resistant to adrenal suppression by dexamethasone. No stigmata of Cushing syndrome were present. The patient had symptoms of pronounced fatigue. Menopause had occurred at age 43. The patient's only child, a son, aged 29 years, had periods of inexplicable fatigue that had made him stay home from school and work. Because of the extreme fatigue that led to the mother's working only half-time, Addison's disease was suspected, but rather than hypocortisolism, elevation of urinary cortisol values was found. Bronnegard et al. (1986) found that the end-organ insensitivity to cortisol was not due to decreased concentration or ligand affinity of the receptor. Rather the woman and her son showed an increased thermolability of the cortisol receptor, a phenomenon also observed with the androgen receptor in patients with the testicular feminization syndrome (300068).

Lamberts et al. (1986) described cortisol resistance in a 26-year-old woman with hirsutism, mild virilization, and menstrual difficulties. They thought that the abnormality was autosomal dominant because her father and 2 brothers had increased plasma cortisol concentrations that did not suppress normally in response to dexamethasone. No hypertension or hypokalemic alkalosis was present. The proband had male-pattern scalp baldness. Nawata et al. (1987) studied a 27-year-old woman with the syndrome of glucocorticoid resistance. She was initially thought to have Cushing disease, based on high plasma ACTH and serum cortisol levels, increased urinary cortisol secretion, resistance to adrenal suppression with dexamethasone, and bilateral adrenal hyperplasia by computed tomography and scintigraphy; however, she had no clinical signs or symptoms of Cushing syndrome. Laboratory studies indicated that the patient's glucocorticoid resistance was due to a decrease in the affinity of the receptor for glucocorticoids and a decrease in the binding of the GCCR complex to DNA.

Corticotrophinomas

As cortisol resistance can be caused by genetic abnormalities in the GRL gene, Huizenga et al. (1998) investigated whether the insensitivity of corticotropinomas to cortisol is also caused by de novo GRL mutations. Except for 1 silent point mutation, they did not identify mutations in the GRL gene in leukocytes or corticotropinomas from 22 patients with Cushing disease. Of the 22 patients, 18 were heterozygous for at least 1 polymorphism, and 6 of the 18 had loss of heterozygosity (LOH) in the tumor DNA. They concluded that LOH at the GRL locus is a relatively frequent phenomenon in pituitary adenomas of patients with Cushing disease and that this may explain the relative resistance of the adenoma cells to the inhibitory feedback action of cortisol on ACTH secretion.

Examples of resistance to cortisol are known; the guinea pig is a 'corticoresistant' species (Vingerhoeds et al. 1976).

Two New World primates, the squirrel monkey and the marmoset, have markedly elevated plasma cortisol levels without physiologic evidence of glucocorticoid hormone excess. Chrousos et al. (1982) showed that their hypothalamic-pituitary-adrenal axis is resistant to suppression by dexamethasone. They studied glucocorticoid receptors in circulating monocytes and cultured skin fibroblasts of New and Old World monkeys and found that, although the receptor content was the same in all species, the 2 New World species had markedly decreased binding affinity for dexamethasone. The presumed mutation must have occurred after bifurcation of the Old and New World primates (about 60 Myr ago) and before diversion of the 2 New World species (about 15 Myr ago). A difference between the disorder in man with an affinity defect of the glucocorticoid receptor and the state in New World monkeys is that in the severe form of the human disease, sodium-retaining corticoids (corticosterone and deoxycorticosterone) are elevated many-fold, producing hypertension and hypokalemic alkalosis. The mineralocorticoid overproduction, which does not occur in the New World monkeys, is probably due to corticotropin hyperstimulation of the adrenal cortex.

Glucocorticoid hormones, like other classes of steroid hormones, exert their cellular action by complexing with a specific cytoplasmic receptor which in turn translocates to the nucleus and binds to specific sites on chromatin. The glucocorticoid receptor was the first transcription factor to be isolated and studied in detail (Muller and Renkawitz, 1991). The glucocorticoid receptor (GCCR) is crucial to gene expression. It is a 94-kD polypeptide and according to one model is thought to have distinct steroid-binding and DNA-binding domains. Weinberger et al. (1985) used expression cloning techniques to select human glucocorticoid receptor cDNA.

Hollenberg et al. (1985) identified cDNAs encoding the human glucocorticoid receptor (symbolized hGR by them). These DNAs predicted 2 protein forms of 777 (alpha) and 742 (beta) amino acids, which differ in their carboxy termini. The proteins contain a cysteine/lysine/arginine-rich region which may define the DNA-binding domain.

Weinberger et al. (1985, 1987) pointed out that the glucocorticoid receptor that they cloned is related to the erb-A family of oncogenes (see 190120 and 190160). Cloned members of the erb oncogene family showed a strong relatedness to the DNA-binding domain of the glucocorticoid receptor. A short region of GRL was homologous to certain homeotic proteins of *Drosophila*. Carlstedt-Duke et al. (1987) analyzed the domain structure of the rat liver GCR protein. The steroid-binding domain, defined by a unique tryptic cleavage, corresponded to the COOH-terminal protein with the domain border in the region of residue 518. The DNA-binding domain, defined by a region with chymotryptic cleavage sites, was immediately adjacent to the steroid-binding domain with its border in the region of residues 410-414.

Of the 2 isoforms of the glucocorticoid receptor generated by alternative splicing, GR-alpha is a ligand-activated transcription factor that, in the hormone-bound state, modulates the expression of glucocorticoid-responsive genes by binding to a specific glucocorticoid response element (GRE) DNA sequence. In contrast, GR-beta does not bind glucocorticoids and is transcriptionally inactive. Bamberger et al. (1995) demonstrated that GR-beta is able to inhibit the effects of hormone-activated GR-alpha on a glucocorticoid-responsive reporter gene in a concentration-dependent manner. The inhibitory effect appeared to be due to competition for GRE target sites. Since RT-PCR analysis showed expression of GR-beta mRNA in multiple human tissues, GR-beta may be a physiologically and pathophysiologically relevant endogenous inhibitor of glucocorticoid action and may participate in defining the sensitivity of tissues to glucocorticoids.

Roux et al. (1996) found that mutation of isoleucine-747 to threonine in the C-terminal portion of the ligand-binding domain of NR3C1 alters the specificity of the ligand for transactivation. Whereas natural glucocorticoids such as cortisol or corticosterone were completely inactive, synthetic steroids like dexamethasone efficiently stimulated I747T mutant NR3C1-mediated transactivation. The basis for the inability of cortisol to activate I747T was predicted from the canonical 3-dimensional structure of nuclear receptor ligand-binding domains because isoleucine-747 is in the direct vicinity of residues that contribute to the ligand-binding pocket.

Using oligonucleotide-directed mutagenesis, Lind et al. (1996) found functional substitutions of residue 736 with serine (cys736 to ser) and threonine (cys736 to thr). The cys736-to-ser protein showed reduced sensitivity to all hormones tested in transactivation assays and a reduced hormone binding affinity. A correspondence between sensitivity to hormone in transactivation assays and hormone-binding affinity was also observed for the cys736-to-thr protein. The authors concluded that very conservative substitutions of cys736, including serine and threonine, cause variable effects on hormone binding that distinguish between different glucocorticoid steroid hormones.

Diamond et al. (2000) showed, in diverse cell types, that glucocorticoids can up- or down-modulate aggregation and nuclear localization of expanded polyglutamine polypeptides derived from the androgen receptor (AR; 313700) or huntingtin (HD; 143100) through specific regulation of gene expression. Wildtype glucocorticoid receptor, as well as C-terminal deletion derivatives, suppressed the aggregation and nuclear localization of these polypeptides, whereas mutations within the DNA-binding domain and the N terminus of GCR abolished this activity. Surprisingly, deletion of a transcriptional regulatory domain within the GCR N terminus markedly increased aggregation and nuclear localization of the expanded polyglutamine proteins. Thus, aggregation and nuclear localization of expanded polyglutamine proteins are regulated cellular processes that can be modulated by a well-characterized transcriptional regulator, the GCR. The findings suggested approaches to study the molecular pathogenesis and selective neuronal degeneration of polyglutamine expansion diseases.

Glucocorticoid Receptor-Beta

Oakley et al. (1996) examined the expression, biochemical properties, and physiologic function of GR-beta. They found that the GR-beta message has a widespread tissue distribution. Although the GRL gene had previously been reported to consist of 10 exons (Encio and Detera-Wadleigh, 1991), Oakley et al. (1996) suggested that the GRL sequences formerly identified as exon 9-alpha, intron J, and exon 9-beta comprise 1 large terminal exon (exon 9) of approximately 4.1 kb and that the GRL gene is organized into 9 rather than 10 exons. They demonstrated that GR-beta resides primarily in the nucleus of transfected cells independent of hormone treatment. Oakley et al. (1996) showed that dominant-negative activity occurs in cells that have endogenous GR-alpha receptors. In addition, they demonstrated that the repression of GR-alpha activity occurs with the simple promoter pGRE2CAT, indicating that the repression is a general phenomenon of glucocorticoid-responsive promoters and that GRE-mediated transcription is actually inhibited.

Corticosteroids have specific effects on cardiac structure and function mediated by mineralocorticoid and glucocorticoid receptors (MR and GR, respectively). Aldosterone and corticosterone are synthesized in rat heart. To see whether they might also be synthesized in the human cardiovascular system, Kayes-Wandover and White (2000) examined the expression of genes for steroidogenic enzymes as well as genes for GR, MR, and 11-hydroxysteroid dehydrogenase (HSD11B2; 218030), which maintains the specificity of MR. Human samples were from left and right atria, left and right ventricles, aorta, apex, intraventricular septum, and atrioventricular node, as well as whole adult and fetal heart. Using RT-PCR, mRNAs encoding CYP11A (118485), CYP21 (201910), CYP11B1 (202010), GR, MR, and HSD11B2 were detected in all samples except ventricles, which did not express CYP11BJ. CYP11B2 (124080) mRNA was detected in the aorta and fetal heart, but not in any region of the adult heart, and CYP17 (202110) was not detected in any cardiac sample. Levels of steroidogenic enzyme gene expression were typically 0.1% those in the adrenal gland. The authors concluded that these findings are consistent with autocrine or paracrine roles for corticosterone and deoxycorticosterone, but not cortisol or aldosterone, in the normal adult human heart.

Neutrophils are markedly less sensitive to glucocorticoids than are T lymphocytes. Using immunofluorescence, Western blot, and RNA dot blot analyses, Strickland et al. (2001) showed that GR-alpha and GR-beta are both expressed on mononuclear cells and neutrophils, with GR-beta expression somewhat greater than GR-alpha on neutrophils. IL8 (146930) stimulation of neutrophils resulted in a significant increase in GR-beta but not GR-alpha expression in neutrophils. Unlike human neutrophils, mouse neutrophils do not express GR-beta. Transfection of GR-beta into mouse neutrophils led to a significant reduction in the cell death rate when exposed to dexamethasone. Strickland et al. (2001) concluded that the high constitutive and proinflammatory cytokine-inducible upregulation of GR-beta in neutrophils enhances their survival during glucocorticoid treatment of inflammation. They proposed that this knowledge may help in the development of novel antiinflammatory strategies.

Glucocorticoid Receptor-Gamma

Rivers et al. (1999) described GR-gamma, a novel variant of GCCR in which, as a result of alternative splicing, 3 bases are retained from the intron separating exons 3 and 4. These 3 bases code for an additional amino acid (arginine) in the DNA-binding domain of the receptor. Insertion of arginine at this site had previously been shown to decrease transcriptional activation by the GR to 48% that of GR-alpha (Ray et al., 1996). Analysis of cDNA from different tissues showed that GR-gamma is widely expressed at a relatively high level (between 3.8% and 8.7% of total GR).

Gehring et al. (1984 1985) achieved mapping of GRL to chromosome 5 by study of hybrids of a human lymphoblastic cell line (that is glucocorticoid-sensitive and contains glucocorticoid receptors of wildtype characteristics) and a mouse lymphoma cell line (that is resistant to lysis by glucocorticoids because of a mutant receptor that exhibits abnormal DNA binding).

Weinberger et al. (1985) used a cDNA clone in connection with a panel of somatic hybrid cells with various rearrangements involving chromosome 5 to assign GCCR to 5q11-q13. However, Francke and Foellmer (1989) demonstrated by in situ hybridization that the GRL gene is located on 5q31-q32. The new assignment is consistent with linkage to a DNA marker that maps to the same region (Giuffra et al. 1988) and also with human/mouse comparative mapping data. From family linkage studies, Giuffra et al. (1988) likewise concluded that the GRL locus is located toward the end of the long arm of chromosome 5.

Hollenberg et al. (1985) confirmed the assignment of a glucocorticoid receptor gene to chromosome 5 by Southern analysis of a hybrid cell line containing only chromosome 5. In addition, 2 fragments (formed with EcoRI and Hind III) were found in total human DNA and not in the hybrid line. To map these, Hollenberg et al. (1985) used a dual-laser fluorescence-activated cell sorter and spot-blotting. This confirmed the assignment to chromosome 5 and in addition showed hGR sequences on chromosome 16. The assignment to chromosome 16 was confirmed by Southern analysis of DNA from a mouse erythroleukemia cell line containing human chromosome 16. They concluded that both the alpha and beta receptor proteins are probably encoded by a single gene on chromosome 5 and generated by alternative splicing. In addition they concluded that a gene on chromosome 16 contains homology to the glucocorticoid receptor gene, at least between nucleotides 570 and 1,640. This could be the receptor gene for a related steroid, a processed gene or pseudogene, or a gene with other function that shares a domain with the GRL gene. See 138060.

Theriault et al. (1989) used in situ hybridization with a biotinylated cDNA probe to localize the human GRL gene to human chromosome 5q31. The assignment was confirmed by hybridization to chromosomes from an individual with a balanced reciprocal translocation (5;8)(q31;q13). Using chromosome-5-linked DNA probes to study somatic cell hybrids retaining partial chromosome 5 and clinical samples from patients with acquired deletions of 5q, Huebner et al. (1990) concluded that the GRL gene is telomeric to CSF2 (138960) and centromeric to CSF1R (164770)/PDGFRB (173410), near ECGF (131220).

Huizenza et al. (2000) described 5 patients with biochemical and clinical cortisol resistance. They found alterations in receptor number or ligand affinity and/or the ability of dexamethasone to inhibit mitogen-induced cell proliferation. To investigate the molecular defects leading to the clinical and biochemical pictures in these patients, they screened the GCCR gene using PCR-SSCP sequence analysis. No GCCR gene alterations were found in these patients. The authors concluded that alterations somewhere in the cascade of events starting with ligand binding to the GCCR protein, and finally resulting in the regulation of the expression of glucocorticoid-responsive genes, or postreceptor defects or interactions with other nuclear factors, form the pathophysiologic basis of cortisol resistance in these patients.

Inflammatory responses in many cell types are coordinately regulated by the opposing actions of NF-kappa-B (164011) and the glucocorticoid receptor. Webster et al. (2001) reported the identification of a tumor necrosis factor (TNF)-responsive NF-kappa-B DNA-binding site 5-prime to the GCCR promoter that leads to a 1.5-fold increase in GR-alpha mRNA and a 2.0-fold increase in GR-beta mRNA in HeLaS3 cells, which endogenously express both glucocorticoid receptor isoforms. However, TNF-alpha (191160) treatment disproportionately increased the steady-state levels of the GR-beta protein isoform over GR-alpha, making GR-beta the predominant endogenous receptor isoform. Similar results were observed following treatment of human lymphoid cells with TNF-alpha or interleukin-1 (IL1; see 147760). The increase in GR-beta protein expression correlated with the development of glucocorticoid resistance.

Animal Model

Pepin et al. (1992) developed transgenic mice in which antisense RNA complementary to the 3-prime noncoding region of the glucocorticoid receptor mRNA led to reduced glucocorticoid receptor capacity and function, predominantly in neuronal tissue. Montkowski et al. (1995) demonstrated that the transgenic mice have profound behavioral changes and elevated plasma corticotropin concentrations in response to stress. Treatment with moclobemide, an inhibitor of monoamine oxidase type A (309850), reversed the behavioral deficits in this mouse model.

Since the glucocorticoid receptor can influence transcription both through DNA-binding-dependent and -independent mechanisms, Reichardt et al. (1998) attempted to separate these modes of action by introducing the arg458-to-thr point mutation into the glucocorticoid receptor by gene targeting using the Cre/loxP system. This mutation impairs dimerization and therefore GRE-dependent transactivation, while functions that require cross-talk with other transcription factors, such as transrepression of AP-1-driven genes, remain intact. In contrast to GR-/- mice, these mutants, termed GR-dim, are viable, revealing the in vivo relevance of DNA-binding-independent activities of the glucocorticoid receptor. The GR-dim/dim mice lose the ability to transactivate gene transcription by cooperative DNA binding but retain the repressing function of the corticosteroid receptor. Furthermore, the development and function of the adrenal medulla are not impaired in these mice.

The glucocorticoid receptor controls transcription of target genes both directly by interaction with DNA regulatory elements and indirectly by cross-talk with other transcription factors. In response to various stimuli, including stress, glucocorticoids coordinate metabolic, endocrine, immune, and nervous system responses and ensure an adequate profile of transcription. In the brain, glucocorticoid receptor has been thought to modulate emotional behavior, cognitive functions, and addictive states. These aspects could not be studied in the absence of functional glucocorticoid receptor because inactivation of the Grl1 gene in mice causes lethality at birth. Therefore, Tronche et al. (1999) generated tissue-specific mutations of this gene using the Cre/loxP-recombination system. This allowed them to generate viable adult mice with loss of glucocorticoid receptor function in selected tissues. Loss of glucocorticoid receptor function in the nervous system impaired regulation of the hypothalamus-pituitary-adrenal axis, resulting in increased glucocorticoid levels that lead to symptoms reminiscent of those observed in Cushing syndrome. Conditional mutagenesis of glucocorticoid receptor in the nervous system provided genetic evidence for the importance of glucocorticoid receptor signaling in emotional behavior because mutant animals showed an impaired behavioral response to stress and displayed reduced anxiety.

Using a tandem array of mouse mammary tumor virus reporter elements and a form of glucocorticoid receptor labeled with green fluorescent protein, McNally et al. (2000) observed targeting of the receptor to response elements in live mouse cells. Photobleaching experiments provided direct evidence that the hormone-occupied receptor undergoes rapid exchange between chromatin and the nucleoplasmic compartment. Thus, McNally et al. (2000) concluded that the interaction of regulatory proteins with target sites in chromatin is a more dynamic process than had been believed.

0.0001 Glucocorticoid Resistance, Familial [NR3C1, ASP641VAL]

In the kindred originally reported by Vingerhoeds et al. (1976) and studied by Chrousos et al. (1982, 1983) and Lipsett et al. (1985), Hurley et al. (1991) sequenced the glucocorticoid receptor from 3 affected members. A change at nucleotide 2054 predicted substitution of valine for aspartic acid at amino acid residue 641. The propositus was homozygous while the other relatives were heterozygous for the mutation. The point mutation was in the steroid-binding domain of the receptor.

0.0002 Glucocorticoid Resistance, Familial [NR3C1, IVS6DS, 4-BP DEL]

In all 3 affected members of a Dutch kindred, Karl et al. (1993) found that 1 NR3C1 allele had a 4-bp deletion that removed the donor splice site affecting the last 2 bases of the exon and the first 2 nucleotides of intron 6. The father and 3 of 5 children were affected. Affected members had hypercortisolism and approximately half of normal glucocorticoid receptors. The proband was a daughter with manifestations of hyperandrogenism. Furthermore, in the proband, in 1 of her affected brothers, and in her unaffected sister, Karl et al. (1993) found a single nucleotide substitution, asparagine to serine at codon 363 in exon 2 (G1220). Transfection studies indicated that the amino acid substitution did not alter the function of the glucocorticoid receptor. The presence of the null allele in this family was apparently compensated for by increased cortisol production at the expense of concurrent hyperandrogenism.

0.0003 Glucocorticoid Resistance, Cellular [NR3C1, LEU753PHE]

Ashraf and Thompson (1993) showed that 2 glucocorticoid-resistant cell lines were hemizygous for a leu753-to-phe mutation. Both were derived from a wildtype cell line heterozygous for this mutation; the resistant cell lines had suffered the loss of the normal allele.

0.0007 Glucocorticoid Receptor Polymorphism [NR3C1, ASN363SER

Koper et al. (1997) identified a polymorphism, located at nucleotide position 1220 (AAT to AGT), that results in an asparagine-to-serine change in codon 363 of the NR3C1 protein. Huizenga et al. (1998) investigated whether this polymorphism is associated with altered sensitivity to glucocorticoids. In a group of 216 elderly persons, they identified 13 heterozygotes for the asn363-to-ser polymorphism by PCR/SSCP analysis. Thus, they found the polymorphism in 6.0% of the studied population. Huizenga et al. (1998) concluded that individuals carrying this polymorphism were clinically healthy, but had a higher sensitivity to exogenously administered glucocorticoids, with respect to both cortisol suppression and insulin response. Huizenga et al. (1998) speculated that life-long exposure to the mutated allele may be accompanied by an increased body mass index and a lowered bone mineral density in the lumbar spine with no effect on blood pressure.

Dobson et al. (2001) investigated the association between the 363S allele and risk factors for coronary heart disease and diabetes mellitus in a population of European origin living in the northeast of the United Kingdom. Blood samples from 135 males and 240 females were characterized for 363 allele status. The overall frequency of the 363S allele was 3.0%; 23 heterozygotes (7 males and 16 females) but no 363S homozygotes were identified. These data showed a significant association of the 363S allele with increased waist-to-hip ratio in males but not in females. This allele was not associated with blood pressure, body mass index, serum cholesterol, triglycerides, low-density lipoprotein and high-density lipoprotein cholesterol levels, or glucose tolerance status. The authors concluded that this GR polymorphism may contribute to central obesity in men.

Another sequence comprises sequence encoding Metap11LOC165470 which is similar to methionine aminopeptidase-like 1.

Another sequence comprises sequence encoding TCF4: transcription factor 4.

TCF4 encodes transcription factor 4, a basic helix-turn-helix transcription factor. The protein recognizes an Ephrussi-box ('E-box') binding site ('CANNTG')—a motif first identified in immunoglobulin enhancers. TCF4 is expressed predominantly in pre-B-cells, although it is found in other tissues as well. TCF4 is known to produce multiple transcripts; however as the complete structure is only known for the transcript that encodes the b isoform, that is the variant presented here.

Another sequence comprises sequence encoding IMMUNOGLOBULIN TRANSCRIPTION FACTOR 2 (ITF2). This sequence maps to gene map locus 18q21.

Corneliussen et al. (1991) identified a family of nuclear proteins that bind to a motif of the glucocorticoid response element (GRE) in the enhancer of the murine leukemia virus SL3-3. This motif resembled those found in Ephrussi, or E, boxes (see 147141). Corneliussen et al. (1991) termed this family SEF2 for 'SL3-3 enhancer factors 2.' They cloned the gene encoding one of these proteins, SEF2-1B, from human thymocytes. Corneliussen et al. (1991) found that the SEF2-1B gene encodes a 667-amino acid polypeptide with homology to other basic helix-loop-helix (bHLH) transcription factors. Corneliussen et al. (1991) found multiple related mRNA species, presumed to be the result of differential splicing.

Henthorn et al. (1990) identified a helix-loop-helix transcription factor that bound to the mu-E5 motif of the immunoglobulin heavy chain enhancer and to the kappa-E2 motif found in the light chain enhancer, and designated it rm for 'immunoglobulin transcription factor 2.' nF2 encodes a predicted 623-amino acid protein (Henthorn et al., 1990).

Pscherer et al. (1996) isolated the promoter region of human somatostatin receptor 2 (SSTR2; 182452) and identified a novel initiator element. By screening a mouse brain cDNA expression library, Pscherer et al. (1996) isolated a transcription factor, which they termed SEF2, that bound to the E box of the SSTR2 initiator element. Sequencing revealed that this factor was the murine homolog of human SEF2-1B. DNA binding studies demonstrated that the basal transcription factor TFIIB (189963) can be tethered to the SSTR2 initiator element through physical interaction with SEF2. Northern blotting revealed that SEF2-1B is expressed in human adult and embryonic tissues including heart, brain, placenta, skeletal muscle, and lung.

In a search for polymorphic CTG repeats as candidate genes for bipolar disorder, Breschel et al. (1997) screened a genomic human chromosome 18-specific library and identified a 1.6-kb clone with a CTG(24) repeat that mapped to 18q21.1. The expansion was located in an intron of SEF2-1. The repeat was highly polymorphic in both bipolar and control subjects with an observed heterozygosity of 84%. Expansions of up to CTG(2100) were possible but were not associated with an obvious abnormal phenotype. The location of the repeat was determined by radiation hybrid mapping and by linkage analysis. Analysis of a mouse Sef2-1 gene showed that it contains 22 exons and that many of the introns are more than 10 kb long.

Another sequence comprises sequence encoding CRYZ: crystallin, zeta (quinone reductase); LOC348462. This sequence maps to gene map locus 1p31-p22. There are two sequences associated with CRYZ; Lab designation RA5A-re (SEQ ID NO: 317)-1q21.2 synaptotagmin XI; and Lab designation RA5B-re (SEQ ID NO: 316)-1p31.1 There are two genes: CRYZ and LOC348462- and cryz sits at the start of both.

Crystallins are separated into two classes: taxon-specific, or enzyme, and ubiquitous. The latter class constitutes the major proteins of vertebrate eye lens and maintains the transparency and refractive index of the lens. The former class is also called phylogenetically-restricted crystallins. This gene encodes a taxon-specific crystallin protein which has NADPH-dependent quinone reductase activity distinct from other known quinone reductases. It lacks alcohol dehydrogenase activity although by similarity it is considered a member of the zinc-containing alcohol dehydrogenase family. Unlike other mammalian species, in humans, lens expression is low. One pseudogene is known to exist.

In addition to the alpha, beta, and gamma crystallin families, which are present in the ocular lenses of all vertebrates, a number of other crystallins have been found to be present in high amounts in lenses from phylogenetically restricted groups. Most of these 'taxon-specific' crystallins are pyridine nucleotide-dependent oxidoreductases that are also present at enzymatic levels in nonlenticular tissues. The acquisition of this new function as a lens crystallin generally occurs without gene duplication and apparently without affecting the catalytic role of the enzyme. Zeta-crystallin/quinone reductase was initially described as a major protein in the lens of the guinea pig (Huang et al., 1987), in which a mutation in the gene is associated with hereditary cataracts (Rodriguez et al., 1992). It was later found to be also present in high amounts in the lens of camels (Garland et al., 1991) and at enzymatic levels in a number of nonlenticular tissues of various species. In the lens of guinea pigs and camels, it comprises about 10% of the total soluble protein. Gonzalez et al. (1994) isolated and characterized the human zeta-crystallin gene and its processed pseudogene. The functional gene is composed of 9 exons and spans about 20 kb. The 5-prime flanking region of the gene is rich in G and C (58%) and lacks TATA and CAAT boxes. Previous analysis of the guinea pig gene revealed the presence of 2 different promoters, one responsible for the high lens-specific expression and the other for expression at the enzymatic level in numerous tissues. A comparative analysis with the guinea pig gene showed that a region of approximately 2.5 kb that includes the promoter responsible for the high expression in the lens in the guinea pig is not present in the human gene.

By Southern analysis of human/mouse somatic cell hybrids, Heinzmann et al. (1994) assigned the CRYZ gene to human chromosome 1 and regionalized the assignment to 1p31-p22 by fluorescence in situ hybridization. They also identified 5 RFLPs.

Another sequence (Lab designation RA3_A_rE.txt (SEQ ID NO: 317)) comprises sequence encoding HM13; histocompatibility (minor) 13. This sequence maps to gene map locus 20q11.21.

Signal peptide peptidase, or SPP, catalyzes intramembrane proteolysis of some signal peptides after they have been cleaved from a preprotein. In humans, SPP activity is required to generate signal sequence-derived human lymphocyte antigen-E epitopes that are recognized by the immune system, and to process hepatitis C virus core protein. Weihofen et al. (2002) [PubMed 12077416] identified human SPP as a polytopic membrane protein with sequence motifs characteristic of the presenilin-type aspartic proteases. [supplied by OMIM]

Throughout this application, various publications are referenced. The disclosures of these publications in their-entireties, as well as the references cited in these publications, are hereby incorporated by reference into this application in order to more fully describe the state of the art to which this invention pertains. References containing the sequences of the proteins described herein are also cited throughout this application. These references and the sequence contained within these references are also hereby incorporated by reference for the purposes of describing the gene sequence, chromosomal location, structural properties and functional properties of the genes and gene products described herein.

REFERENCES

Hicks, G. G. et al. "Functional genomics in mice by tagged sequence mutagenesis." Nat Genet 16, 338-44. (1997).

Blay, J. & Brown, K. D. "Functional receptors for epidermal growth factor in an epithelial-cell line derived from the rat small intestine." Biochem J 225, 85-94 (1985).

Blay, J. & Brown, K. D. "Epidermal growth factor promotes the chemotactic migration of cultured rat intestinal epithelial cells." J Cell Pitysiol 124, 107-12 (1985).

Bell, A. C. & Felsenfeld, G. "Methylation of a CTCF-dependent boundary controls imprinted expression of the Igf2 gene." Nature 405, 482-5. (2000).

Ohlsson, R., Renkawitz, R. & Lobanenkov, V. "CTCF is a uniquely versatile transcription regulator linked to epigenetics and disease." Trends Genet 17, 520-7 (2001).

Oldham, S. M., Clark, G. J., Gangarosa, L. M., Coffey, R. J., Jr. & Der, C. J. "Activation of the Raf-1/MAP kinase cascade is not sufficient for Ras transformation of RIE-1 epithelial cells." Proc Natl Acad Sci USA 93, 6924-8 (1996).

von Melchner, H., Reddy, S. & Ruley, H. E. "Isolation of cellular promoters by using a retrovirus promoter trap." Proc Natl Acad Sci USA 87, 3733-7 (1990).

Ahmed, R. & Graham, A. F. "Persistent infections in L cells with temperature sensitive mutants of reovirus." J Virol 23, 250-62 (1977).

Ahmed, R. et al. "Role of the host cell in persistent viral infection: coevolution of L cells and reovirus during persistent infection." Cell 25, 325-32 (1981).

Morgan, D. O. et al. "Insulin-like growth factor II receptor as a multifunctional binding protein." Nature 329, 301-7 (1987).

Tong, P. Y., Tollefsen, S. E. & Kornfeld, S. "The cation-independent mannose 6-phosphate receptor binds insulin-like growth factor II." J Biol Chem. 263, 2585-8 (1988).

Bakay, M., Zhao, P., Chen, J. & Hoffman, E. P. "A web-accessible complete transcriptome of normal human and DMD muscle." Neuromuscul Disord 12 Suppl 1, S125-41 (2002).

Hark, A. T. et al. "CTCF mediates methylation-sensitive enhancer-blocking activity at the H19/Igf2 locus." Nature 405, 486-9 (2000).

Bell, A. C. & Felsenfeld, G. "Methylation of a CTCF-dependent boundary controls imprinted expression of the Igf2 gene." Nature 405, 482-5 (2000).

McFall, A. et al. "Oncogenic Ras blocks anoikis by activation of a novel effector pathway independent of phosphatidylinositol 3-kinase." Mol Cell Biol 21, 5488-99 (2001).

Wright, J. F., Kurosky, A. & Wasi, S. "An endothelial cell-surface form of annexin II binds human cytomegalovirus." Biochem Biophys Res Commun 198, 983-9 (1994).

Zhao, W. Q. et al. "Secretion of Annexin II via activation of insulin receptor and insulin-like growth factor receptor." J Biol Chem 278, 4205-15 (2003).

Nakagawa, H. et al. "Loss of imprinting of the insulin-like growth factor II gene occurs by biallelic methylation in a core region of H19-associated CTCF-binding sites in colorectal cancer." Proc Natl Acad Sci USA 98, 591-6 (2001).

Rainier, S. et al. "Relaxation of imprinted genes in human cancer." Nature 362, 747-9 (1993).

Arceci, R. J.; King, A. A.; Simon, M. C.; Orkin, S. H.; Wilson, D. B. "Mouse GATA-4: a retinoic acid-inducible GATA-binding transcription factor expressed in endodermally derived tissues and heart." Molec. Cell. Biol. 13: 2235-2246, 1993.

Das, A. K.; Helps, N. R.; Cohen, P. T. W.; Barford, D. "Crystal structure of the protein serine/threonine phosphatase 2C at 2.0 angstrom resolution." EMBO J. 15: 6798-6809, 1996.

Mann, D. J.; Campbell, D. G.; McGowan, C. H.; Cohen, P. T. W.: "Mammalian protein serine/threonine phosphatase 2C: cDNA cloning and comparative analysis of amino acid sequences." Biochim. Biophys. Acta 1130: 100-104, 1992.

Takekawa, M.; Maeda, T.; Saito, H.: "Protein phosphatase 2C-alpha inhibits the human stress-responsive p38 and JNK MAPK pathways." EMBO J. 17: 4744-4752, 1998.

Gradi, A.; Imataka, H.; Svitkin, Y. V.; Rom, E.; Raught, B.; Morino, S.; Sonenberg, N.: "A novel functional human eukaryotic translation initiation factor 4G." Molec. Cell. Biol. 18: 334-342, 1998.

Imataka, H.; Gradi, A.; Sonenberg, N.: "A newly identified N-terminal amino acid sequence of human eIF4G binds poly(A)-binding protein and functions in poly(A)-dependent translation." EMBO J. 17: 7480-7489, 1998.

Irurzun A, Sanchez-Palomino S, Novoa I, Carrasco L. "Monensin and nigericin prevent the inhibition of host translation by poliovirus, without affecting p220 cleavage." J Virol 1995 December; 69 (12):7453-60

Raho G, Barone V, Rossi D, Philipson L, Sorrentino V. "The gas 5 gene shows four alternative splicing patterns without coding for a protein." DIBIT, Istituto Scientifico San Raffaele, Milan, Italy. Gene 256 (1-2):13-7 Oct. 3, 2000.

Lai W S, Thompson M J, Blackshear P J. "Characteristics of the intron involvement in the mitogen-induced expression of Zfp-36." J Biol Chem 273(1):506-17 1998 Jan. 2;

Hu, S.-I.; Carozza, M.; Klein, M.; Nantermet, P.; Luk, D.; Crowl, R. M.:

"Human HtrA, an evolutionarily conserved serine protease identified as a differentially expressed gene product in osteoarthritic cartilage." J. Biol. Chem. 273: 34406-34412, 1998.

Zumbrunn, J.; Trueb, B. "Localization of the gene for a serine protease with IGF-binding domain (PRSS11) to human chromosome" 10q25.3-q26.2. *Genomics* 45: 461-462, 1997.

Zumbrunn, J.; Trueb, B. "Primary structure of a putative serine protease specific for IGF-binding proteins." *FEBS Lett.* 398: 187-192, 1996.

Johnson, K. R.; Merrick, W. C.; Zoll, W. L.; Zhu, Y. "Identification of cDNA clones for the large subunit of eukaryotic translation initiation factor 3: comparison of homologues from human, *Nicotiana tabacum, Caenorhabditis elegans*, and *Saccharomyces cerevisiae*." *J. Biol.* Chem. 272: 7106-7113, 1997.

Osaka, F.; Kawasaki, H.; Aida, N.; Saeki, M.; Chiba, T.; Kawashima, S.; Tanaka, K.; Kato, S. "A new NEDD8-ligating system for cullin-4A." *Genes Dev.* 12: 2263-2268, 1998.

Ye X Y, Ng T B "Isolation of a new cyclophilin-like protein from chickpeas with mitogenic, antifungal and anti-HIV-1 reverse transcriptase activities." *Life Sci* 2002 Jan. 25; 70(10): 1129-38

Wang P, Cardenas M E, Cox G M, Perfect J R, Heitman J. "Two cyclophilin A homologs with shared and distinct functions important for growth and virulence of *Cryptococcus neoformans*." *EMBO* Rep 2001 June; 2(6):511-8

Quintrell, N.; Lebo, R.; Varmus, H.; Bishop, J. M.; Pettenati, M. J.; Le Beau, M. M.; Diaz, M. O.; Rowley, J. D. "Identification of a human gene (HCK) that encodes a protein-tyrosine kinase and is expressed in hemopoietic cells." *Molec. Cell. Biol.* 7: 2267-2275, 1987.

Ziegler, S. F.; Marth, J. D.; Lewis, D. B.; Perlmutter, R. M. "Novel protein-tyrosine kinase gene (hck) preferentially expressed in cells of hematopoietic origin." *Molec. Cell. Biol.* 7: 2276-2285, 1987.

Deleuze, J. F.; Dhorne, S.; Hazan, J.; Borghi, E.; Raynaud, N.; Pollet, N.; Meunier-Rotival, M.; Deschatrette, J.; Alagille, D.; Hadchouel, M. "Deleted chromosome 20 from a patient with Alagille syndrome isolated in a cell hybrid through leucine transport selection: study of three candidate genes." *Mammalian Genome* 5: 663-669, 1994.

Kaestner, K. H.; Hiemisch, H.; Luckow, B.; Schutz, G. "The HNF-3 gene family of transcription factors in mice: gene structure, cDNA sequence, and mRNA distribution." *Genomics* 20: 377-385, 1994.

Mincheva, A.; Lichter, P.; Schutz, G.; Kaestner, K. H. "Assignment of the human genes for hepatocyte nuclear factor 3-alpha, -beta, and -gamma (HNP3A, HNF3B, HNP3G) to 14q12-q13, 20p11, and 19q13.2-q13.4." *Genomics* 39: 417-419, 1997.

Nagase, T.; Ishikawa, K.; Miyajima, N.; Tanaka, A.; Kotani, H.; Nomura, N.; Ohara, O. "Prediction of the coding sequences of unidentified human genes. IX. The complete sequences of 100 new cDNA clones from brain which can code for large proteins in vitro." *DNA Res.*"5: 31-39, 1998.

Nakamura, H.; Sudo, T.; Tsuiki, H.; Miyake, H.; Morisaki, T.; Sasaki, J.; Masuko, N.; Kochi, M.; Ushio, Y.; Saya, H. "Identification of a novel human homolog of the *Drosophila* dlg, P-dlg, specifically expressed in the gland tissues and interacting with p55." *FEBS Lett.* 433: 63-67, 1998.

Aso, T.; Haque, D.; Fukudome, K.; Brower, C. S.; Conaway, J. W.; Conaway, R. C. "A human cDNA encoding the 110-kDa A subunit of RNA polymerase II transcription factor elongin." *Gene* 168: 277-278, 1996.

Aso, T.; Lane, W. S.; Conaway, J. W.; Conaway, R. C. "Elongin (SIII): a multisubunit regulator of elongation by RNA polymerase II." *Science* 269: 1439-1443, 1995.

Aso, T.; Mokady, N.; Haque, D.; Conaway, R. C.; Conaway, J. W. "Assignment of a human gene encoding the 110-kDa subunit of general transcription factor elongin (SIII) to chromosome 1p36.1." *Genomics* 30: 393-394, 1995.

Duan, D. R.; Pause, A.; Burgess, W. H.; Aso, T.; Chen, D. Y. T.; Garrett, K. P.; Conaway, R. C.; Conaway, J. W.; Linehan, W. M.; Klausner, R. D. "Inhibition of transcription elongation by the VHL tumor suppressor protein." *Science* 269: 1402-1406, 1995.

Kibel, A.; Iliopoulos, O.; DeCaprio, J. A.; Kaelin, W. G., Jr. "Binding of the von Hippel-Lindau tumor suppressor protein to elongin B and C." *Science* 269: 1444-1446, 1995.

Kavsak, P.; Rasmussen, R. K.; Causing, C. G.; Bonni, S.; Zhu, H.; Thomsen, G. H.; Wrana, J. L. "Smad7 binds to Smurf2 to form an E3 ubiquitin ligase that targets the TGF-beta receptor for degradation." *Molec. Cell* 6: 1365-1375, 2000.

Lallemand, F.; Mazars, A.; Prunier, C.; Bertrand, F.; Kornprost, M.; Gallea, S.; Roman-Roman, S.; Cherqui, G.; Atfi, A. "Smad7 inhibits the survival nuclear factor kappa-B and potentiates apoptosis in epithelial cells." *Oncogene* 20: 879-884, 2001.

Roijer, E.; Moren, A.; ten Dijke, P.; Stenman, G. "Assignment of the Smad7 gene (MADH7) to human chromosome 18q21.1 by fluorescence in situ hybridization." *Cytogenet. Cell Genet.* 81: 189-190, 1998.

Topper, J. N.; Cai, J.; Qiu, Y.; Anderson, K. R.; Xu, Y.-Y.; Deeds, J. D.; Feeley, R.; Gimeno, C. J.; Woolf, E. A.; Tayber, O.; Mays, G. G.; Sampson, B. A.; Schoen, F. J.; Gimbrone, M. A., Jr.; Falb, D. "Vascular MADs: two novel MAD-related genes selectively inducible by flow in human vascular endothelium. Proc. Nat. Acad." *Sci.* 94: 9314-9319, 1997.

Groden, J.; Thliveris, A.; Samowitz, W.; Carlson, M.; Gelbert, L.; Albertsen, H.; Joslyn, G.; Stevens, J.; Spirio, L.; Robertson, M.; Sargeant, L.; Krapcho, K.; Wolff, E.; Burt, R.; Hughes, J. P.; Warrington, J.; McPherson, J.; Wasmuth, J.; Le Paslier, D.; Abderrahim, H.; Cohen, D.; Leppert, M.; White, R. "Identification and characterization of the familial adenomatous polyposis coli gene." *Cell* 66: 589-600, 1991.

Horii, A.; Nakatsuru, S.; Ichii, S.; Nagase, I L; Nakamura, Y. "Multiple forms of the APC gene transcripts and their tissue-specific expression." *Hum. Molec. Genet.* 2: 283-287, 1993.

Joslyn, G.; Carlson, M.; Thliveris, A.; Albertsen, H.; Gelbert, L.; Samowitz, W.; Groden, J.; Stevens, J.; Spirio, L.; Robertson, M.; Sargeant, L.; Krapcho, K.; Wolff, E.; Burt, R.; Hughes, J. P.; Warrington, J.; McPherson, J.; Wasmuth, J.; Le Paslier, D.; Abderrahim, H.; Cohen, D.; Leppert, M.; White, R. "Identification of deletion mutations and three new genes at the familial polyposis locus." *Cell* 66: 601-613, 1991.

Larsen, N.; Samuelsson, T.; Swieb, C. "The Signal Recognition Particle Database (SRPDB)." *Nucleic Acids Res.* 26: 177-178, 1998.

Lingelbach, K; Zweib, C.; Webb, J.; Marshailsay, C.; Hoben, P.; Walter, P.; Dobberstein, B. "Isolation and characterization of a cDNA clone encoding the 19 kDa protein of signal recognition particle (SRP): expression and binding to 7SL RNA." *Nucleic Acids Res.* 16 9431-9442, 1988.

Wild, K; Sinning, I.; Cusack, S. "Crystal structure of an early protein-RNA assembly complex of the signal recognition particle." *Science* 294: 598-601, 2001.

Davis, D. B.; Delmonte, A. J.; Ly, C. T.; McNally, E. M. "Myoferlin, a candidate gene and potential modifier of muscular dystrophy." *Hum. Molec. Genet.* 9: 217-226, 2000.

Hull, E.; Sarkar, M.; Spruijt, M. P. N.; Hoppener, J. W. M.; Dunn, R.; Schachter, H. "Organization and localization to chromosome 5 of the human UDP-N acetylglucosamine: alpha-3-D-mannoside beta-1,2-N-acetylglucosaminyl-transferase 1 gene." *Biochem. Biophys. Res. Commun.* 176: 608-615, 1991.

Ioffe, E.; Stanley, P. "Mice lacking N-acetylglucosaminyl-transferase I activity die at mid-gestation, revealing an essential role for complex or hybrid N-linked carbohy-drates." *Proc. Nat. Acad. Sci.* 91: 728-732, 1994.

Kumar, R.; Stanley, P. "Transfection of a human gene that corrects the Lec1 glycosylation defect: evidence for trans-fer of the structural gene for N-acetylglucosaminyltrans-ferase I." *Molec. Cell. Biol.* 9: 5713-5717, 1989. Note: Erratum: Molec. Cell. Biol. 10: 3857 only, 1990.

Kumar, R.; Yang, J.; Eddy, R. L.; Byers, M. G.; Shows, T. B.; Stanley, P. "Cloning and expression of the murine gene and chromosomal location of the human gene encoding N-acetylglucosaminyltransferase I." *Glycobiology* 2: 383-393, 1992.

Kumar, R.; Yang, J.; Larsen, R. D.; Stanley, P. "Cloning and expression of N-acetylglucosaminyltransferase L the medial Golgi transferase that initiates complex N-linked carbohydrate formation." *Proc. Nat. Acad. Sci.* 87: 9948-9952, 1990.

Metzler, M.; Gertz, A.; Sarkar, M.; Schachter, H.; Schrader, J. W.; Marth, J. D. "Complex asparagine-linked oligosaccha-rides are required for morphogenic events during post-implantation development." *EMBO J.* 13: 2056-2065, 1994.

Pownall, S.; Kozak, C. A.; Schappert, K.; Sarkar, M.; Hull, E.; Schachter, H.; Marth, J. D. "Molecular cloning and char-acterization of the mouse UDP-N-acetylglucosamine:al-pha-3-D-mannoside beta-1,2-N-acetylglucosaminyltrans-ferase I gene." *Genomics* 12: 699-704, 1992.

Puthalakath, H.; Burke, J.; Gleeson, P. A. "Glycosylation defect in lec1 Chinese hamster ovary mutant is due to a point mutation in N-acetylglucosaminyltransferase 1 gene." *J. Biol. Chem.* 271: 27818-27822, 1996.

Tan, J.; D'Agostaro, G. A. F.; Bendiak, B.; Reck, F.; Sarkar, M.; Squire, J. A.; Leong, P.; Schachter, H. "The human UDP-N-acetylglucosamine:alpha-6-D-mannoside-beta-1, 2-N-acetylglucosaminyltransferase II gene (MGAT2): cloning of genomic DNA, localization to chromosome 14q21, expression in insect cells and purification of the recombinant protein." *Europ. J. Biochem.* 231: 317-328, 1995.

Yip, B.; Chen, S.-H.; Mulder, H.; Hoppener, J. W. M.; Schachter, H. "Organization of the human beta-1,2-N-acetylglucosaminyltransferase I gene (MGAT1), which controls complex and hybrid N-glycan synthesis." *Biochem. J.* 321: 465-474, 1997.

Takagaki, Y.; MacDonald, C. C.; Shenk, T.; Manley, J. L. "The human 64 kDa polyadenylylation (sic) factor con-tains a ribonucleoprotein-type RNA binding domain and unusual auxiliary motifs." *Proc. Nat. Acad. Sci.* 89: 1403-1407, 1992.

Takagaki, Y.; Manley, J. L. "Levels of polyadenylation factor CstF-64 control IgM heavy chain mRNA accumulation and other events associated with B cell differentiation." *Molec. Cell* 2: 761-771, 1998.

Takagaki, Y.; Seipelt, R. L.; Peterson, M. L.; Manley, J. L. "The polyadenylation factor CstF-64 regulates alternative processing of IgM heavy chain pre-mRNA during B cell differentiation." *Cell* 87: 941-952, 1996.

Kapanadze, B.; Kashuba, V.; Baranova, A.; Rasool, O.; van Everdink, W.; Liu, Y.; Syomova, A.; Corcoran, M.; Polt-araus, A.; Brodyansky, V.; Syomova, N.; Kazakov, A.; Ibbotson, R.; van den Berg, A.; Gizatullin, R.; Fedorova, L.; Sulimova, G.; Zelenin, A.; Deaven, L.; Lehrach, H.; Grander, D.; Buys, C.; Oscier, D.; Zabarovsky, E. R.; Ein-horn, S.; Yankovsky, N. "A cosmid and cDNA fine physical map of a human chromosome 13q14 region frequently lost in B-cell chronic lymphocytic leukemia and identification of a new putative tumor suppressor gene, Leu5." *FEBS Lett.* 426: 266-270, 1998.

Liu, Y.; Hermanson, M.; Grander, D.; Merup, M.; Wu, X.; Heyman, M.; Rasool, O.; Juliusson, G.; Gahrton, G.; Det-lofsson, R. "13q deletions in lymphoid malignancies." *Blood* 86: 1911-1915, 1995.

Liu, Y.; Szekely, L.; Grander, D.; Soderhall, S.; Juliusson, G.; Gahrton, G.; Linder, S.; Einhorn, S. "Chronic lymphocytic leukemia cells with allelic deletions at 13q14 commonly have one intact RB1 gene: evidence for a role of an adjacent locus." *Proc. Nat. Acad. Sci.* 90: 8697-8701, 1993.

Pahl, P. M. B.; Hodges, Y. K.; Meltesen, L.; Perryman, M. B.; Horwitz, K. B.; Horwitz, L. D. "ZNF207, a ubiquitously expressed zinc finger gene on chromosome 6p21.3." *Genomics* 53: 410-412, 1998.

Deed, R. W.; Hirose, T.; Mitchell, E. L. D.; Santibanez-Koref, M. F.; Norton, J. D. "Structural organisation and chromo-somal mapping of the human Id-3 gene." *Gene* 151: 309-314, 1994.

Ellmeier, W.; Aguzzi, A.; Kleiner, E.; Kurzbauer, R.; Weith, A. "Mutually exclusive expression of a helix-loop-helix gene and N-myc in human neuroblastomas and in normal development." *EMBO J.* 11: 2563-2571, 1992.

Kee, B. L.; Rivera, R. R.; Murre, C. "Id3 inhibits B lympho-cyte progenitor growth and survival in response to TGF-beta." *Nature Immun.* 2: 242-247, 2001.

Lyden, D.; Young, A. Z.; Zagzag, D.; Yan, W.; Gerald, W.; O'Reilly, R.; Bader, B. L.; Hynes, R. O.; Zhuang, Y.; Manova, K.; Benezra, R. "Id1 and 1d3 are required for neurogenesis, angiogenesis and vascularization of tumour xenografts." *Nature* 401: 670-677, 1999.

Pan, L.; Sato, S.; Frederick, J. P.; Sun, X.-H.; Zhuang, Y. "Impaired immune responses and B-cell proliferation in mice lacking the Id3 gene." *Molec. Cell, Biol.* 19: 5969-5980, 1999.

White, P. S.; Maris, J. M.; Beltinger, C.; Sulman, E.; Marshall, H. N.; Fujimori, M.; Kaufman, B. A.; Biegel, J. A.; Allen, C.; Hilliard, C.; Valentine, M. B.; Look, A. T.; Enomoto, H.; Sakiyama, S.; Brodeur, G. M. "A region of consistent deletion in neuroblastoma maps within human chromo-some 1p36.2-36.3." *Proc. Nat. Acad. Sci.* 92: 5520-5524, 1995.

Lam, E.; Martin, M.; Wiederrecht, G. "Isolation of a cDNA encoding a novel human FK506-binding protein homolog containing leucine zipper and tetratricopeptide repeat motifs." *Gene* 160: 297-302, 1995.

Kitamura H. Kanehira K, Okita K, Morimatsu M, Saito M. "A novel nuclear I kappa B protein that potentiates LPS-in-duced IL-6 production." *FEBS Lett* 17; 485(1):53-6 2000 Nov.

Bertin, J.; Nir, W.-J.; Fischer, C. M.; Tayber, O. V.; Errada, P. R.; Grant, J. R.; Keilty, J. J.; Gosselin, M. L.; Robison, K. E.; Wong, G. H. W.; Glucksmann, M. A.; DiStefano, P. S. "Human CARD4 protein is a novel CED4/Apaf-1 cell death family member that activates NF-kappa-B." *J. Biol. Chem.* 274: 12955-12958, 1999.

Inohara, N.; Koseki, T.; del Peso, L.; Hu, Y.; Yee, C.; Chen, S.; Carrio, R.; Merino, I.; Liu, D.; Ni, J.; Nunez, G. "Nod1, an Apaf-1-like activator of caspase-9 and nuclear factor-kappa-B." *J. Biol. Chem.* 274: 14560-14567, 1999.

Ge, B.; Gram, H.; Di Padova, F.; Huang, B.; New, L.; Ulevitch, R. J.; Luo, Y.; Han, J. "MAPKK-independent activation of p38-alpha mediated by TAB1-dependent autophosphorylation of p38-alpha." *Science* 295: 1291-1294, 2002.

Shibuya, H.; Yamaguchi, K.; Shirakabe, K.; Tonegawa, A.; Gotoh, Y.; Ueno, N.; Irie, K.; Nishida, E.; Matsumoto, K. TAB1: an activator of the TAK1 MAPKKK in TGF-beta signal transduction. *Science* 272: 1179-1182, 1996.

Ge B, Gram H, Di Padova F, Huang B, New L, Ulevitch R J, Luo Y, Han J. "MAPKK-independent activation of p38alpha mediated by TAB1-dependent autophosphorylation of p38alpha." *Science;* 295(5558):1291-4 2002 Feb. 15

Beck, S.; Hanson, I.; Kelly, A.; Pappin, D. J.; Trowsdale, J. "A homologue of the *Drosophila* female sterile homeotic (fsh) gene in the class II region of the human MHC." *DNA Sequence* 2: 203-210, 1992.

Denis, G. V.; Green, M. R. "A novel, mitogen-activated nuclear kinase is related to a *Drosophila* developmental regulator." *Genes Dev.* 10: 261-271, 1996.

Nomura, N.; Nagase, T.; Miyajima, N.; Sazuka, T.; Tanaka, A.; Sato, S.; Seki, N.; Kawarabayasi, Y.; Ishikawa, K.; Tabata, S. "Prediction of the coding sequences of unidentified human genes. II. The coding sequences of 40 new genes (KIAA0041-KIAA0080) deduced by analysis of cDNA clones from human cell line KG-1." *DNA Res.* 1: 223-229, 1994.

Okamoto, N.; Ando, A.; Kawai, J.; Yoshiwara, T.; Tsuji, K.; Inoko, H. "Orientation of HLA-DNA gene and identification of a CpG island-associated gene adjacent to DNA in human major histocompatibility complex class II region." *Hum. Immun.* 32: 221-228, 1991.

Thorpe, K. L.; Abdulla, S.; Kaufman, J.; Trowsdale, J.; Beck, S. "Phylogeny and structure of the RING3 gene." *Immunogenetics* 44: 391-396, 1996.

Dorin, J. R.; Emslie, E.; van Heyningen, V. "Related calcium-binding proteins map to the same subregion of chromosome 1q and to an extended region of synteny on mouse chromosome 3." *Genomics* 8: 420-426, 1990.

Ferrari, S.; Calabretta, B.; deRiel, J. K.; Battini, R.; Ghezzo, F.; Lauret, E.; Griffin, C.; Emanuel, B. S.; Gurrieri, F.; Baserga, R. "Structural and functional analysis of a growth-regulated gene, the human calcyclin." *J. Biol. Chem.* 262: 8325-8332, 1987.

Oakey, R. J.; Watson, M. L.; Seldin, M. F. "Construction of a physical map on mouse and human chromosome 1: comparison of 13 Mb of mouse and 11 Mb of human DNA." *Hum. Molec. Genet.* 1: 613-620, 1992.

Schafer, B. W.; Wicki, R.; Engelkamp, D.; Mattei, M.-G.; Heizmann, C. W. "Isolation of a YAC clone covering a cluster of nine S100 genes on human chromosome 1q21: rationale for a new nomenclature of the S100 calcium-binding protein family." *Genomics* 25: 638-643, 1995.

Seldin, M. F. van Heyningen, V.; Emslie, E.; Dorin, J. R. "Related calcium binding proteins map to the same subregion of chromosome 1q and to an extended region of synteny on mouse chromosome 3." *Cytogenet. Cell Genet.* 51: 1095 only, 1989.

Pinol-Roma, S.; Swanson, M. S.; Gall, J. G.; Dreyfuss, G.: "A novel heterogeneous nuclear RNP protein with a unique distribution on nascent transcripts." *J. Cell Biol.* 109: 2575-2587, 1989.

Crompton, M. R.; Moss, S. E.; Crumpton, M. J. "Diversity in the lipocortin/calpactin family." *Cell* 55: 1-3, 1988.

Horlick, K. R.; Cheng, I. C.; Wong, W. T.; Wakeland, E. K.; Nick, H. S. "Mouse lipocortin I gene structure and chromosomal assignment: gene duplication and the origins of a gene family." *Genomics* 10: 365-374, 1991.

Huebner, K.; Cannizzaro, L. A.; Croce, C. M.; Frey, A. Z.; Wallner, B. P.; Hecht, B. K.; Hecht, P. "Chromosome localization of the human genes for lipocortin I and the lipocortin II family. (Abstract) *Cytogenet. Cell Genet.* 46: 631 only, 1987.

Huebner, K.; Cannizzaro, L. A.; Frey, A. Z.; Hecht, B. K; Hecht, F.; Croce, C. M.; Wallner, B. P. "Chromosomal localization of the human genes for lipocortin I and lipocortin II." *Oncogene Res.* 2: 299-310, 1988.

Kaplan, R.; Jaye, M.; Burgess, W. H.; Schlaepfer, D. D.; Haigler, H. T. "Cloning and expression of cDNA for human endonexin II, a Ca(2+) and phospholipid binding protein." *J. Biol. Chem.* 263: 8037-8043, 1988.

Pepinsky, R. B.; Tizard, R.; Mattaliano, R. J.; Sinclair, L. K.; Miller, G. T.; Browning, J. L.; Chow, E. P.; Burne, C.; Huang, K.-S.; Pratt, D.; Wachter, L.; Hession, C.; Frey, A. Z.; Wallner, B. P. "Five distinct calcium and phospholipid binding proteins share homology with lipocortin I." *J. Biol. Chem.* 263: 10799-10811, 1988.

Shohat, M.; Korenberg, J. R.; Schwabe, A. D.; Rotter, J. I. "Hypothesis: familial Mediterranean fever—a genetic disorder of the lipocortin family?" *Am. J. Med. Genet.* 34: 163-167, 1989.

Wallner, B. P.; Mattaliano, R. J.; Hession, C.; Cate, R. L.; Tizard, R.; Sinclair, L. K.; Foeller, C.; Chow, E. P.; Browning, J. L.; Ramachandran, K. L.; Pepinsky, R. B. "Cloning and expression of human lipocortin, a phospholipase A2 inhibitor with potential anti-inflammatory activity." *Nature* 320: 77-81, 1986.

Walther, A.; Riehemann, K; Gerke, V. "A novel ligand of the formyl peptide receptor: annexin I regulates neutrophil extravasation by interacting with the FPR." *Molec. Cell* 5: 831-840, 2000.

Blanchard, E. M.; Iizuka, K.; Christe, M.; Conner, D. A.; Geisterfer-Lowrance, A.; Schoen, F. J.; Maughan, D. W.; Seidman, C. E.; Seidman, J. G. "Targeted ablation of the murine alpha-tropomyosin gene." *Circulation Res.* 81: 1005-1010, 1997.

Brown, J. H.; Kim, K.-H.; Jun, G.; Greenfield, N. J.; Dominguez, R.; Volkmann, N.; Hitchcock-DeGregori, S. E.; Cohen, C. "Deciphering the design of the tropomyosin molecule." *Proc. Nat. Acad. Sci.* 98: 8496-8501, 2001.

Eyre, H.; Akkari, P. A.; Wilton, S. D.; Callen, D.C.; Baker, E.; Laing, N. G. "Assignment of the human skeletal muscle alpha-tropomyosin gene (TPM1) to band 15q22 by fluorescence in situ hybridization." *Cytogenet. Cell Genet.* 69: 15-17, 1995.

"Karibe, A.; Tobacman, L. S.; Strand, J.; Butters, C.; Back, N.; Bachinski, L. L.; Arai, A. E.; Ortiz, A.; Roberts, R.; Homsher, E.; Fananapazir, L. "Hypertrophic cardiomyopathy caused by a novel alpha-tropomyosin mutation (V95A) is associated with mild cardiac phenotype, abnormal calcium binding to troponin, abnormal myosin cycling, and poor prognosis." *Circulation* 103: 65-71, 2001.

Lees-Miller, J. P.; Helfman, D. M. "The molecular basis for tropomyosin isoform diversity." *BioEssays* 13: 429-437, 1991.

MacLeod, A. R.; Gooding, C. "Human h™-alpha gene: expression in muscle and nonmuscle tissue." *Molec. Cell. Biol.* 8: 433-440, 1988.

Muthuchamy, M.; Pieples, K.; Rethinasamy, P.; Hoit, B.; Grupp, I. L.; Boivin, G. P.; Wolska, B.; Evans, C.; Solaro, R. J.; Wieczorek, D. F. "Mouse model of a familial hypertrophic cardiomyopathy mutation in alpha-tropomyosin manifests cardiac dysfunction." *Circ. Res.* 85: 47-56, 1999.

Schleef, M.; Werner, K.; Satzger, U.; Kaupmann, K.; Jockusch, H. "Chromosomal localization and genomic cloning of the mouse alpha-tropomyosin gene Tpm-1." *Genomics* 17: 519-521, 1993.

Thierfelder, L.; Watkins, H.; MacRae, C.; Lamas, R.; McKenna, W.; Vosberg, H.-P.; Seidman, J. G.; Seidman, C. E. "Alpha-tropomyosin and cardiac troponin T mutations cause familial hypertrophic cardiomyopathy: a disease of the sarcomere." *Cell* 77: 701-712, 1994.

Tiso, N.; Rampoldi, L.; Pallavicini, A.; Zimbello, R.; Pandolfo, D.; Valle, G.; Lanfranchi, G.; Danieli, G. A. "Fine mapping of five human skeletal muscle genes: alpha-tropomyosin, beta-tropomyosin, troponin-I slow-twitch, troponin-I fast-twitch, and troponin-C fast." *Biochem. Biophys. Res. Commun.* 230: 347-350, 1997.

Watkins, H.; Anan, R.; Coviello, D. A.; Spirito, P.; Seidman, J. G.; Seidman, C. E.: "A de novo mutation in alpha-tropomyosin that causes hypertrophic cardiomyopathy." *Circulation* 91: 2302-2305, 1995.

Watkins, H.; McKenna, W. J.; Thierfelder, L.; Suk, H. J.; Anan, R.; O'Donoghue, A.; Spirito, P.; Matsumori, A.; Moravec, C. S.; Seidman, J. G.; Seidman, C. E. "Mutations in the genes for cardiac troponin T and alpha-tropomyosin in hypertrophic cardiomyopathy." *New Eng. J. Med.* 332: 1058-1064, 1995.

Gillespie, G. A. J.; Somlo, S.; Germino, G. G.; Weinstat-Saslow, D.; Reeders, S. T.: CpG island in the region of an autosomal dominant polycystic kidney disease locus defines the 5-prime end of a gene encoding a putative proton channel. *Proc. Nat. Acad. Sci.* 88: 4289-4293, 1991.

Bell, A. C.; Felsenfeld, G.:

Methylation of a CTCF-dependent boundary controls imprinted expression of the Igf2 gene. *Nature* 405: 482-485, 2000.

Bell, A. C.; West, A. G.; Felsenfeld, G.: "The protein CTCF is required for the enhancer blocking activity of vertebrate insulators." *Cell* 98: 387-396, 1999.

Chao, W.; Huynh, K. D.; Spencer, R. J.; Davidow, L. S.; Lee, J. T.: "CTCF, a candidate trans-acting factor for X-inactivation choice." *Science* 295: 345-347, 2002.

Filippova, G. N.; Fagerlie, S.; Klenova, E. M.; Myers, C.; Dehner, Y.; Goodwin, G.; Neiman, P. E.; Collins, S. J.; Lobanenkov, V. V.: "An exceptionally conserved transcriptional repressor, CTCF, employs different combinations of zinc fingers to bind diverged promoter sequences of avian and mammalian c-myc oncogenes." *Molec. Cell. Biol.* 16: 2802-2813, 1996.

Filippova, G. N.; Thienes, C. P.; Penn, B. H.; Cho, D. H.; Hu, Y. J.; Moore, J. M.; Klesert, T. R.; Lobanenkov, V. V.; Tapscott, S. J.:

CTCF-binding sites flank CTG/CAG repeats and form a methylation-sensitive insulator at the DM1 locus. *Nature Genet.* 28: 335-343, 2001.

Hark, A. T.; Schoenherr, C. J.; Katz, D. J.; Ingram, R. S.; Levrose, J. M.; Tilghman, S. M.:

CTCF mediates methylation-sensitive enhancer-blocking activity at the H19/Igf2 locus. *Nature* 405: 486-489, 2000.

Agulnik, A. I.; Zharkikh, A.; Boettger-Tong, H.; Bourgeron, T.; McElreavey, K.; Bishop, C. E.:

Evolution of the DAZ gene family suggests that Y-linked DAZ plays little, or a limited, role in spermatogenesis but underlines a recent African origin for human populations. *Hum. Molec. Genet.* 7: 1371-1377, 1998.

Eberhart, C. G.; Maines, J. Z.; Wasserman, S. A.: Meiotic cell cycle requirement for a fly homologue of human Deleted in Azoospermia. *Nature* 381: 783-785, 1996.

Rugglu, M.; Speed, R.; Taggart, M.; McKay, S. J.; Kilanowski, F.; Saunders, P.; Derin, J.; Cooke, H. J.: The mouse Dazla gene encodes a cytoplasmic protein essential for gametogenesis. *Nature* 389: 73-77, 1997.

Saxena, R.; Brown, L. G.; Hawkins, T.; Alagappan, R. K.; Skaletsky, H.; Reeve, M. P.; Reijo, R.; Rozen, S.; Dinulos, M. B.; Disteche, C. M.; Page, D. C.: The DAZ gene cluster on the human Y chromosome arose from an autosomal gene that was transposed, repeatedly amplified and pruned. *Nature Genet.* 14: 292-299, 1996.

Shan, Z.; Hirschmann, P.; Seebacher, T.; Edelmann, A.; Jauch, A.; Morell, J.; Urbitsch, P.; Vogt, P. H.: A SPGY copy homologous to the mouse gene Dazla and the *Drosophila* gene boule is autosomal and expressed only in the human male gonad. *Hum. Molec. Genet.* 5: 2005-2011, 1996.

Slee, R.; Grimes, B.; Speed, R. M.; Taggart, M.; Maguire, S. M.; Ross, A.; McGill, N. I.; Saunders, P. T. K.; Cooke, H. J.: A human DAZ transgene confers partial rescue of the mouse Daz1 null phenotype. *Proc. Nat. Acad. Sci.* 96: 8040-8045, 1999.

Yen, P. H.; Chai, N. N.; Salido, E. C.: The human autosomal gene DAZLA: testis specificity and a candidate for male infertility. *Hum. Molec. Genet.* 5: 2013-2017, 1996.

Huebner, K.; Cannizzaro, L. A.; Croce, C. M.; Frey, A. Z.; Wallner, B. P.; Hecht, B. K.; Hecht, F.: Chromosome localization of the human genes for lipocortin I and the lipocortin II family. (Abstract) *Cytogenet. Cell Genet.* 46: 631 only, 1987.

Huebner, K.; Cannizzaro, L. A.; Frey, A. Z.; Hecht, B. K.; Hecht, F.; Croce, C. M.; Wallner, B. P.: Chromosomal localization of the human genes for lipocortin I and lipocortin II. *Oncogene Res.* 2: 299-310, 1988.

Richard, I.; Broux, O.; Chiannilkulchai, N.; Fougerousse, F.; Allamand, V.; Bourg, N.; Brenguier, L.; Devaud, C.; Pasturaud, P.; Roudaut, C.; Lorenzo, P.; Sebastiani-Kabatchis, C.; Schultz, R. A.; Polymeropoulos, M. H.; Gyapay, G.; Auffray, C.; Beckmann, J. S.: Regional localization of human chromosome 15 loci. *Genomics* 23: 619-627, 1994.

Spano, F.; Raugei, G.; Palla, E.; Colella, C.; Melli, M.:

Characterization of the human lipocortin-2-encoding multigene family: its structure suggests the existence of a short amino acid unit undergoing duplication. *Gene* 95: 243-251, 1990.

Takahashi, S.; Reddy, S. V.; Chirgwin, J. M.; Devlin, R.; Haipek, C.; Anderson, J.; Roodman, G. D.: Cloning and identification of annexin II as an autocrine/paracrine factor that increases osteoclast formation and bone resorption. *J. Biol. Chem.* 269: 28696-28701, 1994.

Chellaiah, A.; Davis, A.; Mohanakumar, T.: Cloning of a unique human homologue of the *Escherichia coli* DNAJ heat shock protein. *Biochim. Biophys. Acta* 1174: 111-113, 1993.

Osaka, F.; Kawasaki, H.; Aida, N.; Saeki, M.; Chiba, T.; Kawashima, S.; Tanaka, K.; Kato, S.: A new NEDD8-ligating system for cullin-4A. *Genes Dev.* 12: 2263-2268, 1998.

Date, H.; Onodera, O.; Tanaka, H.; Iwabuchi, K; Uekawa, K.; Igarashi, S.; Koike, R.; Hiroi, T.; Yuasa, T.; Awaya, Y.; Sakai, T.; and 9 others: Early-onset ataxia with ocular motor apraxia and hypoalbuminemia is caused by mutations in a new HIT superfamily gene. *Nature Genet.* 29: 184-188, 2001.

Moreira, M.-C.; Barbot, C.; Tachi, N.; Kozuka, N.; Uchida, E.; Gibson, T.; Mendonca, P.; Costa, M.; Barros, J.; Yanagisawa, T.; Watanabe, M.; Ikeda, Y.; Aoki, M.; Nagata, T.; Coutinho, P.; Sequeiros, J.; Koenig, M.: The gene mutated in ataxia-oculomotor apraxia 1 encodes the new HIT/Zn-finger protein aprataxin. *Nature Genet.* 29: 189-193, 2001.

Ohkuma, Y.; Sumimoto, H.; Hoffmann, A.; Shimasaki, S.; Horikoshi, M.; Roeder, R. G.: Structural motifs and potential sigma homologies in the large subunit of human general transcription factor TFIIE. *Nature* 354: 398-401, 1991.

Peterson, M. G.; Inostroza, J.; Maxon, M. E.; Flores, O.; Admon, A.; Reinberg, D.; Tjian, R.: Structure and functional properties of human general transcription factor IIE. *Nature* 354: 369-373, 1991.

Yudkovsky, N.; Ranish, J. A.; Hahn, S.:

A transcription reinitiation intermediate that is stabilized by activator. *Nature* 408: 225-229, 2000.

Umbricht, C. B.; Erdile, L. F.; Jabs, E. W.; Kelly, T. J.: Cloning, overexpression, and genomic mapping of the 14-kDa subunit of human replication protein A. *J. Biol. Chem.* 268: 6131-6138, 1993.

Umbricht, C. B.; Griffin, C. A.; Hawkins, A. L.; Grzeschik, K. H.; O'Connell, P.; Leach, R.; Green, E. D.; Kelly, T. J.: High-resolution genomic mapping of the three human replication protein A genes (RPA1, RPA2, and RPA3). *Genomics* 20: 249-257, 1994.

Erdile, L. F.; Heyer, W.-D.; Kolodner, R.; Kelly, T. J.: Characterization of a cDNA encoding the 70-kDa single-stranded DNA-binding subunit of human replication protein A and the role of the protein in DNA replication. *J. Biol. Chem.* 266: 12090-12098, 1991.

Gomes, X. V.; Wold, M. S.: Functional domains of the 70-kilodalton subunit of human replication protein A. *Biochemistry* 35: 10558-10568, 1996.

Miyamoto, Y.; Saito, Y.; Nakayama, M.; Shimasaki, Y.; Yoshimura, T.; Yoshimura, M.; Harada, M.; Kajiyama, N.; Kishimoto, I.; Kuwahara, K.; Hino, J.; Ogawa, E.; Hamanaka, I.; Kamitani, S.; Takahashi, N.; Kawakami, R.; Kangawa, K.; Yasue, H.; Nakao, K.: Replication protein A1 reduces transcription of the endothelial nitric oxide synthase gene containing a −786T-C mutation associated with coronary spastic angina. *Hum. Molec. Genet.* 9: 2629-2637, 2000.

Nakayama, M.; Yasue, H.; Yoshimura, M.; Shimasaki, Y.; Kugiyama, K.; Ogawa, H.; Motoyama, T.; Saito, Y.; Ogawa, Y.; Miyamoto, Y.; Nakao, K: T(−786)-C mutation in the 5-prime-flanking region of the endothelial nitric oxide synthase gene is associated with coronary spasm. *Circulation* 99: 2864-2870, 1999.

Shen, L. X.; Basilion, J. P.; Stanton, V. P., Jr.: Single-nucleotide polymorphisms can cause different structural folds of mRNA. *Proc. Nat. Acad. Sci.* 96: 7871-7876, 1999.

Umbricht, C. B.; Erdile, L. F.; Jabs, E. W.; Kelly, T. J.: Cloning, overexpression, and genomic mapping of the 14-kDa subunit of human replication protein A. *J. Biol. Chem.* 268: 6131-6138, 1993.

Umbricht, C. B.; Griffin, C. A.; Hawkins, A. L.; Grzeschik, K. H.; O'Connell, P.; Leach, R.; Green, E. D.; Kelly, T. J.:

High-resolution genomic mapping of the three human replication protein A genes (RPA1, RPA2, and RPA3). *Genomics* 20: 249-257, 1994.

Acquati, F.; Malgaretti, N.; Hauptschein, R.; Rao, P.; Gaidano, G.; Taramelli, R.:

A 2-Mb YAC contig linking the plasminogen-apoprotein(a) gene family to the insulin-like growth factor 2 receptor (IGF2R) gene on the telomeric region of chromosome 6 (6q26-q27). *Genomics* 22: 664-666, 1994.

Barlow, D. P.; Stoger, R.; Herrmann, B. G.; Saito, K; Schweifer, N.:

The mouse insulin-like growth factor type-2 receptor is imprinted and closely linked to the Tme locus. *Nature* 349: 84-87, 1991.

DeChiara, T. M.; Robertson, E. J.; Efstratiadis, A.:

Parental imprinting of the mouse insulin-like growth factor II gene. *Cell* 64: 849-859, 1991.

De Souza, A. T.; Hankins, G. R.; Washington, M. K.; Fine, R. L.; Orton, T. C.; Jirtle, R. L.:

Frequent loss of heterozygosity on 6q at the mannose 6-phosphate/insulin-like growth factor II receptor locus in human hepatocellular tumors. *Oncogene* 10: 1725-1729, 1995.

De Souza, A. T.; Hankins, G. R.; Washington, M. K.; Orton, T. C.; Jirtle, R. L.:

M6P/IGF2R gene is mutated in human hepatocellular carcinomas with loss of heterozygosity. *Nature Genet.* 11: 447-449, 1995.

Feinberg, A. P.:

Genomic imprinting and gene activation in cancer. *Nature Genet.* 4: 110-113, 1993.

Haig, D.; Graham, C.:

Genomic imprinting and the strange case of the insulin-like growth factor II receptor. *Cell* 64: 1045-1046, 1991.

Haig, D.; Westoby, M.:

Parent-specific gene expression and the triploid endosperm. *Am. Nat.* 134: 147-155, 1989.

Kalscheuer, V. M.; Mariman, E. C.; Schepens, M. T.; Rehder, H.; Ropers, H.-H.:

The insulin-like-growth factor type-2 receptor gene is imprinted in the mouse but not in humans. *Nature Genet.* 5: 7478, 1993.

Kiess, W.; Blickenstaff, G. D.; Sklar, M. M.; Thomas, C. L.; Nissley, S. P.; Sahagian, G. G.:

Biochemical evidence that the type II insulin-like growth factor receptor is identical to the cation-independent mannose 6-phosphate receptor. *J. Biol. Chem.* 263: 9339-9344, 1988.

Killian, J. K.; Oka, Y.; Jang, H.-S.; Fu, X.; Waterland, R. A.; Sohda, T.; Sakaguchi, S.; Jirtle, R. L.:

Mannose 6-phosphate/insulin-like growth factor 2 receptor (M6P/IGF2R) variants in American and Japanese populations. *Hum. Mutat.* 18: 25-31, 2001.

Kornfeld, S.; Mellman, I.:

The biogenesis of lysosomes. *Annu. Rev. Cell Biol.* 5: 483-525, 1989.

Lau, M. M. H.; Stewart, C. E. H.; Liu, Z.; Bhatt, H.; Rotwein, P.; Stewart, C. L.:

Loss of the imprinted IGF2/cation-independent mannose 6-phosphate receptor results in fetal overgrowth and perinatal lethality. *Genes Dev.* 8: 2953-2963, 1994.

Laureys, G.; Barton, D. E.; Ullrich, A.; Francke, U.:

Chromosomal mapping of the gene for the type II insulin-like growth factor receptor/cation-independent mannose 6-phosphate receptor in man and mouse. *Genomics* 3: 224-229, 1988.

MacDonald, R. G.; Pfeffer, S. R.; Coussens, L.; Tepper, M. A.; Brocklebank, C. M.; Mole, J. E.; Anderson, J. K:

A single receptor binds both insulin-like growth factor II and mannose-6-phosphate. *Science* 239: 1134-1137, 1988.

Morgan, D. O.; Edman, J. D.; Standring, D. N.; Fried, V. A.; Smith, M. C.; Roth, R. A.; Rutter, W. J.:

Insulin-like growth factor II receptor as a multifunctional binding protein. *Nature* 329: 301-307, 1987.

Motyka, B.; Korbutt, G.; Pinkoski, M. J.; Heibein, J. A.; Caputo, A.; Hobman, M.; Barry, M.; Shostak, I.; Sawchuk, T.; Holmes, C. F. B.; Gauldie, J.; Bleackley, R. C.:

Mannose 6-phosphate/insulin-like growth factor II receptor is a death receptor for granzyme B during cytotoxic T cell-induced apoptosis. *Cell* 103: 491-500, 2000.

Ogawa, O.; McNoe, L. A.; Eccles, M. R.; Morison, I. M.; Reeve, A. E.:

Human insulin-like growth factor type I and type II receptors are not imprinted. *Hum. Molec. Genet.* 2: 2163-2165, 1993.

Oshima, A.; Nolan, C. M.; Kyle, J. W.; Grubb, J. H.; Sly, W. S.:

The human cation-independent mannose 6-phosphate receptor: cloning and sequence of the full-length cDNA and expression of functional receptor in COS cells. *J. Biol. Chem.* 263: 2553-2562, 1988.

Puertollano, R.; Aguilar, R. C.; Gorshkova, I.; Crouch, R. J.; Bonifacino, J. S.:

Sorting of mannose 6-phosphate receptors mediated by the GGAs. *Science* 292: 1712-1716, 2001.

Rao, P. H.; Murty, V. V. V. S.; Gaidano, G.; Hauptschein, R.; Dalla-Favera, R.; Chaganti, R. S. K.:

Subregional mapping of 8 single copy loci to chromosome 6 by fluorescence in situ hybridization. *Cytogenet. Cell Genet.* 66: 272-273, 1994.

Roth, R. A.:

Structure of the receptor for insulin-like growth factor II: the puzzle amplified. *Science* 239: 1269-1271, 1988.

Sleutels, F.; Zwart, R.; Barlow, D. P.:

The non-coding Air RNA is required for silencing autosomal imprinted genes. *Nature* 415: 810-813, 2002.

Souza, R. F.; Appel, R.; Yin, J.; Wang, S.; Smolinski, K. N.; Abraham, J. M.; Zou, T.-T.; Shi, Y.-Q.; Lei, J.; Cottrell, J.; Cymes, K; Biden, K.; Simms, L.; Leggett, B.; Lynch, P. M.; Frazier, M.; Powell, S. M.; Harpaz, N.; Sugimura, H.; Young, J.; Meltzer, S. J.: Microsatellite instability in the insulin-like growth factor II receptor gene in gastrointestinal tumours. (Letter) *Nature Genet.* 14: 255-257, 1996.

Szebeny, G.; Rotwein, P.:

The mouse insulin-like growth factor II/cation-independent mannose 6-phosphate (IGF-II/MPR) receptor gene: molecular cloning and genomic organization. *Genomics* 19: 120-129, 1994.

Tong, P. Y.; Tollefsen, S. E.; Kornfeld, S.:

The cation-independent mannose 6-phosphate receptor binds insulin-like growth factor II. *J. Biol. Chem.* 263: 2585-2588, 1988.

Waheed, A.; Braulke, T.; Junghans, U.; von Figura, K.:

Mannose 6-phosphate/insulin like growth factor II receptor: the two types of ligands bind simultaneously to one receptor at different sites. *Biochem. Biophys. Res. Commun.* 152: 1248-1254, 1988.

Xu, Y.; Goodyer, C. G.; Deal, C.; Polychronakos, C.:

Functional polymorphism in the parental imprinting of the human IGF2R gene. *Biochem. Biophys. Res. Commun.* 197: 747-754, 1993.

Young, L. E.; Fernandes, K.; McEvoy, T. G.; Butterwith, S. C.; Gutierrez, C. G.; Carolan, C.; Broadbent, P. J.; Robinson, J. J.; Wilmut, I.; Sinclair, K. D.:

Epigenetic change in IGF2R is associated with fetal overgrowth after sheep embryo culture. *Nature Genet.* 27: 153-154, 2001.

Zhu, Y.; Doray, B.; Poussu, A.; Lehto, V.-P.; Kornfeld, S. "Binding of GGA2 to the lysosomal enzyme sorting motif of the mannose 6-phosphate receptor." *Science* 292: 1716-1718, 2001.

McGuinness, T.; Porteus, M. H.; Smiga, S.; Bulfone, A.; Kingsley, C.; Qiu, M.; Liu, J. K.; Long, J. E.; Xu, D.; Rubenstein, J. L. R. "Sequence, organization, and transcription of the Dlx-1 and the Dlx-2 locus. *Genomics* 35: 473-485, 1996.

Ozcelik, T.; Porteus, M. H.; Rubenstein, J. L. R.; Francke, U. "DLX2 (TES1), a homeobox gene of the Distal-less family, assigned to conserved regions on human and mouse chromosomes 2." *Genomics* 13: 1157-1161, 1992.

Porteus, M. H.; Brice, A. E. J.; Bulfone, A.; Usdin, T. B.; Ciaranello, R. D.; Rubenstein, J. L. R. "Isolation and characterization of a library of cDNA clones that are preferentially expressed in the embryonic telencephalon." *Molec. Brain Res.* 12: 7-22, 1992.

Qiu, M.; Bulfone, A.; Martinez, S.; Meneses, J. J.; Shimamura, K.; Pedersen, R. A.; Rubenstein, J. L. "Null mutation of Dlx-2 results in abnormal morphogenesis of proximal first and second branchial arch derivatives and abnormal differentiation in the forebrain." *Genes Dev.* 9: 2523-2538, 1995.

Bray, P.; Lichter, P.; Thiesen, H.-J.; Ward, D.C.; Dawid, I. B. "Characterization and mapping of human genes encoding zinc finger proteins." *Proc. Nat. Acad. Sci.* 88: 9563-9567, 1991.

Huebner, K.; Druck, T.; LaForgia, S.; Lasota, J.; Croce, C. M.; Lanfrancone, L.; Donti, B.; Pengue, G.; La Mantia, G.; Pelicci, P.-G.; Lania, L. "Chromosomal localization of four human zinc finger cDNAs." *Hum. Genet.* 91: 217-222, 1993.

Lania, L.; Donti, E.; Pannuti, A.; Pascucci, A.; Pengue, G.; Feliciello, I.; La Mantia, G.; Lanfrancone, L.; Pelicci. P.-G. "cDNA isolation, expression analysis, and chromosomal localization of two human zinc finger genes." *Genomics* 6: 333-340, 1990.

Thiesen, H.-J. "Multiple genes encoding zinc finger domains are expressed in human T cells." *New Biologist* 2: 363-374, 1990.

Boise, L. H.; Gonzalez-Garcia, M.; Postema, C. E.; Ding, L.; Lindsten, T.; Turka, L. A.; Mao, X.; Nunez, G.; Thompson, C. B. "Bcl-x, a bcl-2-related gene that functions as a dominant regulator of apoptotic cell death." *Cell* 74: 597-608, 1993.

Moliterno, A. R.; Hankins, W. D).; Spivak, J. L. "Impaired expression of the thrombopoietin receptor by platelets from patients with polycythemia vera." *New Eng. J. Med.* 338: 572-580, 1998.

Shimizu, S.; Narita, M.; Tsujimoto, Y. "Bcl-2 family proteins regulate the release of apoptogenic cytochrome c by the mitochondrial channel VDAC." *Nature* 399: 483-487, 1999.

Silva, M.; Richard, C.; Benito, A.; Sanz, C.; Olalla, I.; Fernandez-Luna, J. L. "Expression of Bcl-x in erythroid precursors from patients with polycythemia vera." *New Eng. J. Med.* 338: 564-571, 1998.

Vander Heiden, M. G.; Chandel, N. S.; Williamson, E. K; Schumacker, P. T.; Thompson, C. B. "Bcl-X(L) regulates the membrane potential and volume homeostasis of mitochondria." *Cell* 91: 627-637, 1997.

Bauer, W. O.; Nanda, I.; Beck, G.; Schmid, M.; Jakob, F. "Human puromycin-sensitive aminopeptidase: cloning of 3-prime UTR, evidence for a polymorphism at aa 140 and refined chromosomal localization to 17q21." *Cytogenet. Cell Genet.* 92: 221-224, 2001.

Huber, G.; Thompson, A.; Gruninger, F.; Mechler, H.; Hochstrasser, R.; Hauri, H.-P.; Malherbe, P. "cDNA cloning and molecular characterization of human brain metalloprotease MP100: a beta-secretase candidate?" *J. Neurochem.* 72: 1215-1223, 1999.

Osada, T.; Sakaki, Y.; Takeuchi, T. "Puromycin-sensitive aminopeptidase gene (Psa) maps to mouse chromosome 11." *Genomics* 56: 361-362, 1999.

Schonlein, C.; Loffler, J.; Huber, G. "Purification and characterization of a novel metalloprotease from human brain with the ability to cleave substrates derived from the N-terminus of beta-amyloid protein." *Biochem. Biophys. Res. Commun.* 201: 45-53, 1994.

Thompson, M. W.; Tobler, A.; Fontana, A.; Hersh, L. B. "Cloning and analysis of the gene for the human puromycin-sensitive aminopeptidase." *Biochem. Biophys. Res. Commun.* 258: 234-240, 1999.

Tobler, A. R.; Constam, D. B.; Schmitt-Graff, A.; Malipiero, U.; Schlapbach, R.; Fontana, A. "Cloning of the human puromycin-sensitive aminopeptidase and evidence for expression in neurons." *J. Neurochem.* 68: 889-897, 1997.

Tait, J. F.; Frankenberry, D. A.; Miao, C. H.; Killary, A. M.; Adler, D. A.; Disteche, C. M. "Chromosomal localization of the human annexin III (ANX3) gene." *Genomics* 10: 441-448, 1991.

Tait, J. F.; Smith, C.; Xu, L.; Cookson, B. T. "Structure and polymorphisms of the human annexin III (ANX3) gene." *Genomics* 18: 79-86, 1993.

Liang, Y.; Tedder, T. F. "Identification of a CD20-, Fc-epsilon-RI-beta-related gene family: sixteen new MS4A family members expressed in human and mouse." *Genomics* 72:119-127, 2001.

Huston, E.; Lumb, S.; Russell, A.; Catterall, C.; Ross, A. H.; Steele, M. R.; Bolger, G. B.; Perry, M. J.; Owens, R. J.; Houslay, M. D. "Molecular cloning and transient expression in COS7 cells of a novel human PDE4B cAMP-specific phosphodiesterase, HSPDE4B3." *Biochem. J.* 328: 549-558, 1997.

Livi, G. P.; Kmetz, P.; McHale, M. M.; Cieslinski, L. B.; Sathe, G. M.; Taylor, D. P.; Davis, R. L.; Torphy, T. J.; Balcarek, J. M. "Cloning and expression of cDNA for a human low-K(m), rolipram-sensitive cyclic AMP phosphodiesterase." *Molec. Cell. Biol.* 10: 2678-2686, 1990.

Milatovich, A.; Bolger, G.; Michaeli, T.; Francke, U. "Chromosome localizations of genes for five cAMP-specific phosphodiesterases in man and mouse." *Somat. Cell Molec. Genet.* 20: 75-86, 1994.

Obernolte, R.; Bhakta, S.; Alvarez, R.; Bach, C.; Zuppan, P.; Mulkins, M.; Jarnagin, K; Shelton, E. R. "The cDNA of a human lymphocyte cyclic-AMP phosphodiesterase (PDE IV) reveals a multigene family." *Gene* 129: 239-247, 1993.

Szpirer, C.; Szpirer, J.; Riviere, M.; Swinnen, J.; Vicini, E.; Conti, M. "Chromosomal localization of the human and rat genes (PDE4D and PDE4B) encoding the cAMP-specific phosphodiesterases 3 and 4." *Cytogenet. Cell Genet.* 69: 11-14, 1995.

Xu, R. X.; Hassell, A. M.; Vanderwall, D.; Lambert, M. H.; Holmes, W. D.; Luther, M. A.; Rocque, W. J.; Milburn, M. V.; Zhao, Y.; Ke, H.; Nolte, R. T. "Atomic structure of PDE4: insights into phosphodiesterase mechanism and specificity." *Science* 288: 1822-1825, 2000.

Ashraf, J.; Thompson, E. B. "Identification of the activation-labile gene: a single point mutation in the human glucocorticoid receptor presents as two distinct receptor phenotypes." *Molec. Endocr.* 7: 631-642, 1993.

Bamberger, C. M.; Bamberger, A.-M.; de Castro, M.; Chrousos, G. P. "Glucocorticoid receptor beta, a potential endogenous inhibitor of glucocorticoid action in humans." *J. Clin. Invest* 95: 2435-2441, 1995.

Bronnegard, M.; Werner, S.; Gustafsson, J.-A. "Primary cortisol resistance associated with a thermolabile glucocorticoid receptor in a patient with fatigue as the only symptom." *J. Clin. Invest.* 78: 1270-1278, 1986.

Carlstedt-Duke, J.; Stromstedt P.-E.; Wrange, O.; Bergman, T.; Gustafsson, J.-A.; Jornvall, H. "Domain structure of the glucocorticoid receptor protein." *Proc. Nat. Acad. Sci.* 84: 4437-4440, 1987.

Chrousos, G. P.; Renquist, D.; Brandon, D.; Eil, C.; Pugeat, M.; Vigersky, R.; Cutler, G. B., Jr.; Loriaux, D. L.; Lipsett, M. B. "Glucocorticoid hormone resistance during primate evolution: receptor-mediated mechanisms." *Proc. Nat. Acad. Sci.* 79: 2036-2040, 1982.

Chrousos, G. P.; Vingerhoeds, A.; Brandon, D.; Eil, C.; Pugeat, M.; DeVroede, M.; Loriaux, D. L.; Lipsett, M. B. "Primary cortisol resistance in man: a glucocorticoid receptor-mediated disease." *J. Clin. Invest.* 69: 1261-1269, 1982.

Chrousos, G. P.; Vingerhoeds, A. C. M.; Loriaux, D. L.; Lipsett, M. B. "Primary cortisol resistance: a family study." *J. Clin. Endocr. Metab.* 56: 1243-1245, 1983.

Diamond, M. I.; Robinson, M. R.; Yamamoto, K. R. "Regulation of expanded polyglutamine protein aggregation and nuclear localization by the glucocorticoid receptor." *Proc. Nat. Acad. Sci.* 97: 657-661, 2000.

Dobson, M. G.; Redfern, C. P. F.; Unwin, N.; Weaver, J. U. "The N363S polymorphism of the glucocorticoid receptor: potential contribution to central obesity in men and lack of association with other risk factors for coronary heart disease and diabetes mellitus." *J. Clin. Endocr. Metab.* 86: 2270-2274, 2001.

Encio, I. J.; Detera-Wadleigh, S. D. "The genomic structure of the human glucocorticoid receptor." *J. Biol. Chem.* 266: 7182-7188, 1991.

Francke, U.; Foellmer, B. E. "The glucocorticoid receptor gene is in 5q31-q32." *Genomics* 4: 610-612, 1989.

Gehring, U.; Segnitz, B.; Foellmer, B.; Francke, U. "Chromosome assignment of the human gene for the glucocorticoid receptor (GRL)." (Abstract) *Cytogenet. Cell Genet.* 37: 476, 1984.

Gehring, U.; Segnitz, B.; Foellmer, B.; Francke, U. "Assignment of the human gene for the glucocorticoid receptor to chromosome 5." *Proc. Nat. Acad. Sci.* 82: 3751-3755, 1985.

Giuffra, L. A.; Kennedy, J. L.; Castiglione, C. M.; Evans, R. M.; Wasmuth, J. J.; Kidd, K. K. "Glucocorticoid receptor maps to the distal long arm of chromosome 5." *Cytogenet. Cell Genet.* 49: 313-314, 1988.

Hollenberg, S. M.; Weinberger, C.; Ong, E. S.; Cerelli, G.; Oro, A.; Lebo, R.; Thompson, E. B.; Rosenfeld, M. G.; Evans, R. M. "Primary structure and expression of a functional human glucocorticoid receptor cDNA." *Nature* 318: 635-641, 1985.

Huebner, K.; Nagarajan, L.; Besa, E.; Angert, E.; Lange, B. J.; Cannizzaro, L. A.; van den Berghe, H.; Santoli, D.; Finan, J.; Croce, C. M.; Nowell, P. C. "Order of genes on human chromosome 5q with respect to 5q interstitial deletions." *Ant. J. Hum. Genet.* 46: 26-36, 1990.

Huizenga, N. A. T. M.; de Lange, P.; Koper, J. W.; Clayton, R. N.; Farrell, W. E.; van der Lely, A. J.; Brinkmann, A. O.; de Jong, F. H.; Lamberts, S. W. J. "Human adrenocorticotropin-secreting pituitary adenomas show frequent loss of heterozygosity at the glucocorticoid receptor gene locus." *J. Clin. Endocr. Metab.* 83: 917-921, 1998.

Huizenga, N. A. T. M.; De Lange, P.; Koper, J. W.; De Herder, W. W.; Abs, R.; Kasteren, J. H. L. M. V.; De Jong, F. H.; Lamberts, S. W. J. "Five patients with biochemical and/or clinical generalized glucocorticoid resistance without alterations in the glucocorticoid receptor gene." *J. Clin. Endocr. Metab.* 85: 2076-2081, 2000.

Huizenga, N. A. T. M.; Koper, J. W.; de Lange, P.; Pols, H. A. P.; Stolk, R. P.; Burger, H.; Grobbee, D. E.; Brinkmann, A. O.; de Jong, F. H.; Lamberts, S. W. J. "A polymorphism in the glucocorticoid receptor gene may be associated with an increased sensitivity to glucocorticoids in vivo." *J. Clin. Endocr. Metab.* 83: 144-151, 1998.

Hurley, D. M.; Accili, D.; Stratakis, C. A.; Karl, M.; Vamvakopoulos, N.; Rorer, E.; Constantine, K.; Taylor, S. I.; Chrousos, G. P. "Point mutation causing a single amino acid substitution in the hormone binding domain of the glucocorticoid receptor in familial glucocorticoid resistance." *J. Clin. Invest.* 87: 680-686, 1991.

Iida, S.; Gomi, M.; Moriwaki, K.; Itoh, Y.; Hirobe, K.; Matsuzawa, Y.; Katagiri, S.; Yonezawa, T.; Tarui, S. "Primary cortisol resistance accompanied by a reduction in glucocorticoid receptors in two members of the same family." *J. Clin. Endocr. Metab.* 60: 967-971, 1985.

Karl, M.; Lamberts, S. W. J.; Detera-Wadleigh, S. D.; Encio, I. J.; Stratakis, C. A.; Hurley, D. M.; Accili, D.; Chrousos, G. P. "Familial glucocorticoid resistance caused by a splice site deletion in the human glucocorticoid receptor gene." *J. Clin. Endocr. Metab.* 76: 683-689, 1993.

Kayes-Wandover, K.; White, P. C. "Steroidogenic enzyme gene expression in the human heart." *J. Clin. Endocr. Metab.* 85: 2519-2525, 2000.

Kontula, K.; Pelkonen, R.; Andersson, L.; Sivula, A. "Glucocorticoid receptors in adrenocorticoid disorders." *J. Clin. Endocr. Metab.* 51: 654-657, 1980.

Koper, J. W.; Stolk, R. P.; de Lange, P.; Huizenga, N. A.; Molijn, G. J.; Pols, H. A.; Grobbee, D. E.; Karl, M.; de Jong, F. H.; Brinkmann, A. O.; Lamberts, S. W. "Lack of association between five polymorphisms in the human glucocorticoid receptor gene and glucocorticoid resistance." *Hum. Genet.* 99: 663-668, 1997.

Lamberts, S. W. J.; Poldermans, D.; Zweens, M.; de Jong, F. H. "Familial cortisol resistance: differential diagnostic and therapeutic aspects." *J. Clin. Endocr. Metab.* 63: 1328-1333, 1986.

Lind, U.; Carlstedt-Duke, J.; Gustafsson, J.-A.; Wright, A. P. H. "Identification of single amino acid substitutions of cys-736 that affect the steroid-binding affinity and specificity of the glucocorticoid receptor using phenotypic screening in yeast." *Molec. Endocr.* 10: 1358-1370, 1996.

Lipsett, M. B.; Chrousos, G. P.; Tomita, M.; Brandon, D. D.; Loriaux, D. L. "The defective glucocorticoid receptor in man and nonhuman primates." *Recent Prog. Horm. Res.* 41: 199-247, 1985.

Lipsett, M. B.; Tomita, M.; Brandon, D. D.; De Vroede, M. M.; Loriaux, D. L.; Chrousos, G. P. "Cortisol resistance in man. In: Chrousos, G. P.; Loriaux, D. L.; Lipsett, M. B.: Steroid Hormone Resistance: Mechanisms and Clinical Aspects." New York: Plenum Press (pub.) 1986. Pp. 97-109.

McNally, J. G.; Muller, W. G.; Walker, D.; Wolford, R.; Hager, G. L. "The glucocorticoid receptor: rapid exchange with regulatory sites in living cells." *Science* 287: 1262-1265, 2000.

Montkowski, A.; Barden, N.; Wotjak, C.; Stec, I.; Ganster, J.; Meaney, M.; Engelmann, M.; Reul, J. M. H. M.; Landgraf, R.; Holsboer, F. "Long-term antidepressant treatment reduces behavioural deficits in transgenic mice with impaired glucocorticoid receptor function." *J. Neuroendocrinology* 7: 841-845, 1995.

Muller, M.; Renkawitz, R. "Review: the glucocorticoid receptor." *Biochim. Biophys. Acta* 1088: 171-182, 1991.

Nawata, H.; Sekiya, K.; Higuchi, K.; Kato, K.-I.; Ibayashi, H. "Decreased deoxyribonucleic acid binding of glucocorticoid-receptor complex in cultured skin fibroblasts from a patient with the glucocorticoid resistance syndrome." *J. Clin. Endocr. Metab.* 65: 219-226, 1987.

Oakley, R. H.; Sar, M.; Cidlowski, J. A. "The human glucocorticoid receptor isoform: expression, biochemical properties, and putative function." *J. Biol. Chem.* 271: 9550-9559, 1996.

Pepin, M.-C.; Pothier, F.; Barden, N. "Impaired type II glucocorticoid receptor function in mice bearing antisense RNA transgene." *Nature* 355: 725-728, 1992.

Ray, D. W.; Davis, J. R. E.; White, A.; Clark, A. J. L. "Glucocorticoid receptor structure and function in glucocorticoid-resistant small cell lung carcinoma cells." *Cancer Res.* 56: 3276-3280, 1996.

Reichardt, H. M.; Kaestner, K. H.; Tuckermann, J.; Kretz, O.; Wessely, O.; Bock, R.; Gass, P.; Schmid, W.; Herrlich, P.; Angel, P.; Schutz, G. "DNA binding of the glucocorticoid receptor is not essential for survival." *Cell* 93: 531-541, 1998.

Rivers, C.; Levy, A.; Hancock, J.; Lightman, S.; Norman, M. "Insertion of an amino acid in the DNA-binding domain of the glucocorticoid receptor as a result of alternative splicing." *J. Clin. Endocr. Metab.* 84: 4283-4286, 1999.

Roux, S.; Terouanne, B.; Balaguer, P.; Jausons-Loffreda, N.; Pons, M.; Chambon, P.; Gronemeyer, H.; Nicolas, J.-C. "Mutation of isoleucine 747 by a threonine alters the ligand responsiveness of the human glucocorticoid receptor." *Molec. Endocr.* 10: 1214-1226, 1996.

Strickland, I.; Kisich, K; Hank, P. J.; Vottero, A.; Chrousos, G. P.; Klemm, D. J.; Leung, D. Y. M. "High constitutive glucocorticoid receptor beta in human neutrophils enables them to reduce their spontaneous rate of cell death in response to corticosteroids." *J. Exp. Med.* 193: 585-593, 2001.

Theriault, A.; Boyd, E.; Harrap, S. B.; Hollenberg, S. M.; Connor, J. M. "Regional chromosomal assignment of the human glucocorticoid receptor gene to 5q31." *Hum. Genet.* 83: 289-291, 1989.

Theriault, A.; Harrap, S. B.; Hollenberg, S. M.; Boyd, E.; Connor, J. M. "Regional chromosomal assignment of the glucocorticoid receptor gene to 5q31." (Abstract) *Cytogenet. Cell Genet.* 51: 1089, 1989.

Tronche, F.; Kellendonk, C.; Kretz, O.; Gass, P.; Anlag, K.; Orban, P. C.; Bock, R.; Klein, R.; Schutz, O. "Disruption of the glucocorticoid receptor gene in the nervous system results in reduced anxiety." *Nature Genet.* 23: 99-103, 1999.

Vingerhoeds, A. C. M.; Thijssen, J. H. H.; Schwarz, F. "Spontaneous hypercortisolism without Cushing's syndrome." *J. Clin. Endocr. Metab.* 43: 1128-1133, 1976.

Webster, J. C.; Oakley, R. H.; Jewell, C. M.; Cidlowski, J. A. "Proinflammatory cytokines regulate human glucocorticoid receptor gene expression and lead to the accumulation of the dominant negative beta-isoform: a mechanism for the generation of glucocorticoid resistance." *Proc. Nat. Acad. Sci.* 98: 6865-6870, 2001.

Weinberger, C.; Evans, R.; Rosenfeld, M. G.; Hollenberg, S. M.; Skarecky, D.; Wasmuth, J. J. "Assignment of the human gene encoding the glucocorticoid receptor to the q11-q13 region on chromosome 5." (Abstract) *Cytogenet. Cell Genet.* 40: 776, 1985.

Weinberger, C.; Giguere, V.; Hollenberg, S. M.; Thompson, C.; Arriza, J.; Evans, R. M. "Human steroid receptors and erb-A gene products form a superfamily of enhancer-binding proteins." *Clin. Physiol. Biochem.* 5: 179-189, 1987.

Weinberger, C.; Hollenberg, S. M.; Ong, E. S.; Harmon, J. M.; Brower, S. T.; Cidlowski, J.; Thompson, E. B.; Rosenfeld, M. G.; Evans, R. M. "Identification of human glucocorticoid receptor complementary DNA clones by epitope selection." *Science* 228: 740-742, 1985.

Weinberger, C.; Hollenberg, S. M.; Rosenfeld, M. G.; Evans, R. M. "Domain structure of human glucocorticoid receptor and its relationship to the v-erb-A oncogene product." *Nature* 318: 670-672, 1985.

Breschel, T. S.; McInnis, M. G.; Margolis, R. L.; Sirugo, G.; Corneliussen, B.; Simpson, S. G.; McMahon, F. J.; MacKinnon, D. F.; Xu, J. F.; Pleasant, N.; Huo, Y.; Ashworth, R. G.; Grundstrom, C.; Grundstrom, T.; Kidd, K. K.; DePaulo, J. R.; Ross, C. A. "A novel, heritable, expanding CTG repeat in an intron of the SEF2-1 gene on chromosome 18q21.1." *Hum. Molec. Genet.* 6: 1855-1863, 1997.

Corneliussen, B.; Thornell, A.; Hallberg, B.; Grundstrom, T. "Helix-loop-helix transcriptional activators bind to a sequence in glucocorticoid response elements of retrovirus enhancers." *J. Virol.* 65: 6084-6093, 1991.

Henthorn, P.; Kiledjian, M.; Kadesch, T. "Two distinct transcription factors that bind the immunoglobulin enhancer mu-E5/kappa-E2 motif." *Science* 247: 467-470, 1990.

Henthorn, P.; McCarrick-Walmsley, R.; Kadesch, T. "Sequence of the cDNA encoding ITF-2, a positive-acting transcription factor." *Nucleic Acids Res.* 18: 678, 1990.

Pscherer, A.; Dorflinger, U.; Kirfel, J.; Gawlas, K; Ruschoff, J.; Buettner, R.; Schule, R. "The helix-loop-helix transcription factor SEF-2 regulates the activity of a novel initiator element in the promoter of the human somatostatin receptor II gene." *EMBO J.* 15: 6680 6690, 1996.

Garland, D.; Rao, P. V.; Del Corso, A.; Mura, U.; Zigler, J. S., Jr. "Zeta-crystallin is a major protein in the lens of *Camelus dromedarius*." *Arch. Biochem. Biophys.* 285: 134-136, 1991.

Gonzalez, P.; Rao, P. V.; Zigler, J. S., Jr. "Organization of the human zeta-crystallin/quinone reductase gene (CRYZ)." *Genomics* 21: 317-324, 1994.

Heinzmann, C.; Kojis, T. L.; Gonzalez, P.; Rao, P. V.; Zigler, J. S., Jr.; Polymeropoulos, M. H.; Klisak, I.; Sparkes, R. S.; Mohandas, T.; Bateman, J. B. "Assignment of the zeta-crystallin gene (CRYZ) to human chromosome 1p22-p31 and identification of restriction fragment length polymorphisms." *Genomics* 23: 403-407, 1994.

Huang, Q.-L.; Russell, P.; Stone, S. H.; Zigler, J. S., Jr. "Zeta-crystallin, a novel lens protein from the guinea pig." *Curr. Eye Res.* 6: 725-732, 1987.

Rodriguez, I. R.; Gonzalez, P.; Zigler, J. S., Jr.; Borras, T. "A guinea-pig hereditary cataract contains a splice site deletion in a crystallin gene." *Biochim. Biophys. Acta* 1180: 44-52, 1992.

Sawamura, T.; Kume, N.; Aoyama, T.; Moriwaki, H.; Hoshikawa, H.; Aiba, Y.; Tanaka, T.; Miwa, S.; Katsura, Y.; Kita, T.; Masaki, T. "An endothelial receptor for oxidized low-density lipoprotein." *Nature* 386:73-77, 1997.

Yamanaka, S.; Zhang, X.-Y.; Miura, K.; Kim, S.; Iwao, H. "The human gene encoding the lectin-type oxidized LDL receptor (OLR1) is a novel member of the natural killer gene complex with a unique expression profile." *Genomics* 54: 191-199, 1998.

SEQUENCE LISTING (2259 sequences)

SEQ ID NO: 1 - DNA, 4406 bp, Homo sapiens
cggtgcggagcctgtctccttcactggatcccgcattttcagcgcgttgcatcacctccgtgcgcccggttgcagcgtggacgccggatgagttgcttttaggcttgctggcccgcggggctgtccaggcacgcgaggcccctcagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 2 - protein, 1262 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 3 - DNA, 4510 bp, Homo sapiens
cggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgagcaacaaaatgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 4 - protein, 1262 aa, Homo sapiens; identical to SEQ ID NO: 2

SEQ ID NO: 5 - DNA, 5263 bp, Homo sapiens
cggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgta

SEQ ID NO: 6 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 7 - DNA, 8733 bp, Homo sapiens
gctcccggcttagaggacagcggggaaggcgggcggtggggcagggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacatatgtaaaaaaaaa

SEQ ID NO: 8 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 9 - DNA, 1890 bp, Homo sapiens
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggcaaaaaaaaaaaaaaaaaaaa

SEQ ID NO: 10 - protein, 347 aa, Homo sapiens
METPFYGDEALSGLGGGASGSGGSFASPGRLFPGAPPTAAAGSMMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 11 - DNA, 3291 bp, Homo sapiens
agaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaaaaaaaaaaaaaaaaaa

SEQ ID NO: 12 - protein, 648 aa, Homo sapiens [sequence omitted]

SEQ ID NO: 13 - DNA, 2381 bp, Homo sapiens
ggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagcttgctcttgggaggtttccatatcctcagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacaaaaaaaaaaaaaaaaaa

SEQ ID NO: 14 - protein, 448 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 15 - DNA, 2334 bp, Homo sapiens
ggagtaacagtgtcgccgccgccttcctcctcctcctctcgccgctaccgccgtcgccgccgccgcagccgccgccggtccgcgcggcctcgggtggccggagctcagcctgcgcgcgccgcgccctgtgtctccgggtggggcagaagactcgccccttgaacctcccgcggggactctccgtggtgtggcggccctggggctctttcttaatagccccggactgagtcccctccagtcgaggaccctctcctagtccactgacgagcggtggacacctgccgctgtatctcccccaaaccgagtccttgccctgctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgaca

SEQ ID NO: 16 - protein, 438 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 17 - DNA, 3077 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatctttaaaaaaaaaaaaaa

SEQ ID NO: 18 - protein, 859 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQRWDLAVLSWLVSNS

SEQ ID NO: 19 - DNA, 5843 bp, Homo sapiens
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcaga

SEQ ID NO: 20 - protein, 1325 aa, Homo sapiens
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 21 - DNA, 4209 bp, Homo sapiens
ccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaagtgctcagccgagtgtgggacgggaatccagcggcgctctgtggtctgccttgggagtggggcagccctcgggccaggccagggggaagcaggagcaggaactgggcagagctgtccaacaggaagccggccccctgacatgcgcgcctgcagcctggggccctgtgagagaacttggcgctggtacacagggccctggggtgagtgctcctccgaatgtggctctggcacacagcgtagagacatcatctgtgtatccaaactggggacggagttcaacgtgacttctccgagcaactgttctcacctccccaggccccctgccctgcagccctgtcaagggcaggcctgccaggaccgatggttttccacgccctggagcccatgttctcgctcctgccaagggggaacgcagacacgggaggtccagtgcctgagcaccaaccagaccctcagcacccgatgccctcctcaactgcggccctccaggaagcgcccctgtaacagccaaccctgcagccagcgccctgatgatcaatgcaaggacagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctctccagcctgtcccagtctcagcagggatgtcctccaggtgacagagggtggcaaggtgactgacacaaagtgactttcagggctgtggtcaggcccatgtggtggtgtgatgggtgtgtgcacatatgcctcaggtgtgcttttgggactgcatggatatgtgtgtgctcaaacgtgtatcacttttcaaaaagaggttacacagactgagaaggacaagacctgtttccttgagactttcctaggtggaaaggaaagcaagtctgcagttccttgctaatctgagctacttagagtgtggtctccccaccaactccagttttgtgccctaagcctcatttctcatgttcagacctcacatcttctaagccgccctgtgtctctgaccccttctcatttgcctagtatctctgcccctgcctccctaattagctagggctggggtcagccactgccaatcctgccttactcaggaaggcaggaggaaagagactgcctctccagagcaaggcccagctgggcagagggtgaaaaagagaaatgtgagcatccgctcccccaccaccccgcccagcccctagccccactccctgcctcctgaaatggttcccacccagaactaatttattttttattaaagatggtcatgacaaatgagaaaaaaaaaa

SEQ ID NO: 22 - protein, 1074 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 23 - DNA, 2897 bp, Homo sapiens
ccgccgcggagcgaggttgcctggagagagcgcctgggcgcagaagggttaacgggccaccgggggctcgcagagcaggagggtgctctcggacggtgtgtcccccactgcactcctgaacttggaggacagggtcgccgcgagggacgcagagagcaccctccacgcccagatgcctgcgtagtttttgtgaccagtccgctcctgcctccccctggggcagtagagggggagcgatggagaactggactggcaggccctggctgtatctgctgctgcttctgtccctccctcagctctgcttggatcaggaggtgttgtccggacactctcttcagacacctacagaggagggccagggccccgaaggtgtctggggaccttgggtccagtgggcctcttgctcccagccctgcggggtgggggtgcagcgcaggagccggacatgtcagctccctacagtgcagctccacccgagtctgcccctccctccccggcccccaagacatccagaagccctcctcccccggggccagggtcccagaccccagacttctccagaaaccctccccttgtacaggacacagtctcggggaaggggtggcccacttcgaggtcccgcttcccacctagggagagaggagacccaggagattcgagcggccaggaggtcccggcttcgagaccccatcaagccaggaatgttcggttatgggagagtgccctttgcattgccactgcaccggaaccgcaggcaccctcggagcccacccagatctgagctgtccctgatctcttctagaggggaagaggctattccgtcccctactccaagagcagagccattctccgcaaacggcagcccccaaactgagctccctcccacagaactgtctgtccacaccccatccccccaagcagaacctctaagccctgaaactgctcagacagaggtggcccccagaaccaggcctgcccccctacggcatcaccccagagcccaggcctctggcacagagcccccctcacccacgcactccttaggagaaggtggcttcttccgtgcatcccctcagccacgaaggccaagttcccagggttgggccagtccccaggtagcagggagacgccctgatccttttccttcggtccctcggggccgaggccagcagggccaagggccttggggaacgggggggactcctcacgggccccgcctggagcctgaccctcagcacccgggcgcctggctgcccctgctgagcaacggcccccatgccagctccctctggagcctctttgctcccagtagccctattccaagatgttctggggagagtgaacagctaagagcctgcagccaagcgccctgcccccctgagcagccagacccccgggccctgcagtgcgcagcctttaactcccaggaattcatgggccagctgtatcagtgggagcccttcactgaagtccagggctcccagcgctgtgaactgaactgccggccccgtggcttccgcttctatgtccgtcacactgaaaaggtccaggatgggaccctgtgtcagcctggagcccctgacatctgtgtggctggacgctgtctgagccccggctgtgatgggatccttggctctggcaggcgtcctgatggctgtggagtctgtgggggtgatgattctacctgtcgccttgtttcggggaacctcactgaccgagggggccccctgggctatcagaagatcttgtggattccagcgggagccttgcggctccagattgcccagctccggcctagctccaactacctggcacttcgtggccctgggggccggtccatcatcaatgggaactgggctgtggatccccctgggtcctacagggccggcgggaccgtctttcgatataaccgtcctcccagggaggagggcaaaggggagagtctgtcggctgaaggccccaccacccagcctgtggatgtctatatgatctttcaggaggaaaacccaggcgttttttatcagtatgtcatctcttcacctcctccaatccttgagaaccccaccccagagccccctgtcccccagcttcagccggagattctgagggtggagcccccacttgctccggcaccccgcccagcccggaccccaggcaccctccagcgtcaggtgcggatcccccagatgcccgccccgccccatcccaggacacccctggggtctccagctgcgtactggaaacgagtgggacactctgcatgctcagcgtcctgcgggaaaggtgtctggcgccccattttcctctgcatctcccgtgagtcgggagaggaactggatgaacgcagctgtgccgcgggtgccaggcccccagcctcccctgaaccctgccacggcaccccatgccccccatactgggaggctggcgagtggacatcctgcagccgctcctgtggccccggcacccagcaccgccagctgcagtgccggcaggaatttggggggggtggctcctcggtgcccccggagcgctgtggacatctcccccggcccaacatcacccagtcttgccagctgcgcctctgtggccattgggaagttggctctccttggagccagtgctccgtgcggtgcggccggggccagagaagccggcaggttcgctgtgttgggaacaatggtgatgaagtgagcgagcaggagtgtgcgtcaggccccccgcagccccccagcagagaggcctgtgacatggggccctgtactactgcctggttccacagcgactggagctccaaggtgagcccggaacccccagccatatcctgcatcctgggtaaccacgcccaggacacctcagcctttccagcatagctcaataaacttgtattgatcaaaaaa

SEQ ID NO: 24 - protein, 877 aa, Homo sapiens
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKVSPEPPAISCILGNHAQDTSAFPA

SEQ ID NO: 25 - DNA, 9121 bp, Homo sapiens
gcgcaactgacggtcgcgttctgcgcgcgagctagttgcctcccgtacctgccgcggtcgccggccccgcccccgggagcgcgggccaatgggctgggctccagggggcggggctggcgggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaaggtgaaattccacaatttgtgtagggatgtcaaatttcagggtttttttgttgttgttgtgttattttgtggtattgtgcttgttttgtgaaagaatgttttgacagggcctcttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagttgttttttgcaacatggaaagatacgtgaccaaaaggaaagggcaacagcaggagccctgttagtgctgccagaacaccaggaagccttgtgggaggcgtattgtccaagatgatgcgtattgtccaaacgactcagaagaagtcatttctgaagggttgatcataacttccctagccatgttttacctacagagaacttagttagaatttatgagtacagtatgttaaattacttttagtgtaccttaggcagtgtatttgttttgatacagagacaaagactatatgatccctgagacttgttgcctagtgaactcacaagcagatagaattgtacctcagttatttgggtgatttaaagatggtactatggctacactattcccagctatcgttgtgttacagtatttatacaactggaaacatctctctaaatgacaaccattgtatattgttaaataacttatagtcagtggaattctgtgggtttttctttcctacaggcaggaaattatggtgatgtgttgatatgattatatatgtagactattcagttaacatctaggagttagcaaatttgctacattcacaatcagtatgtaagtcagttgtattcctagatatcagcaactaacagaaatggaagtttttagaaagatctcttcaatatcattaaaaaatacaaaatactctacctaagaataagtctaacaaaagatgtacaagatcttgatggagaaaatgttagaccatgtcaggaagcatttaaggagatcttaaataaatgtagtactccataatgtacacgaattagaagactcagtcgtgtaaagatgttcatttacatttgtagattcaatgtaatcccaaccaaaatattttttgcattattacctctatctactgtgtgtttccttaagacaagggcattcctacgtaaccatagtacaaccatcaaacttaggagattgacattgacatcatgatatctaatccatagaccacattcaatctgctgattttgattgcctcagtaatgttcctgtgtttcagcatcccaatccaggaccacatagtgcatttagttgccctatctcttgtttcattcagtccagaacatcttttcagacttgtctttgaccttgacacttgaggaggattggccagtttgtagaaagttcctcagttttggtttatcattagataagacccataaggtttaggatagacatttttgtccaatactacagaaatgatgctctatactcaaatgtgtcatgccaggatgcacacaatgtcaatttgtcttatacctgatagtattaattttggtcacttggttcagatagtatataccaggtttctccattgtaaaattagaattaggaagtaatttgtgaggagattcttaaagattgtaaatgtattgtttctcatcgaattgtcacgggctagtctattgacaattcttgactgaaccaattactattttggttgtcaaatggtgagtccgtggcttctgccttggttggcatcctactactgtaaggaagagctcttccttctctattccttcattcacttaaatcagtatagattcatgaatgcctgctttattcagtgacagtgtattattgtcacttattttcatgctgaaattttccccgatttggtttttgggagtctcttcaagctggcttctgtgttccttagagatgcctcattgctttttcccctcttattttttttacgagctcatcttacactttttcctactccctaccccaagtctagaattagcccttttttccaaggagccctggtttctttaaatgggaaatggtatatggaaatgaagacctgagaaaggctcactgtcttattggtgaacagctcaaaggaaaacgtgtgtctacacacattcaagaatagtcacctacttctatatctatttatatacatacgtattgaaaactttgagttcacattgacaccttcaattcaatcctttgaggttaatctagtctccctttccatctttgtaacttccttctctcatagaaacctgactcccataatcctaaataatttgttcattcttcctccctccctcaacctcttgacatgccagctgctgtctcatcacacccagtcccaaatatgccaaataaatccgcagtcatagcagcgctggtcctgaccacaccaatccctaacatcctccccagcctggagcctggaccatggcagctgaatctttgaccccagtgatgtcagtcctgagcacaccattggaatcctaggctcctgtcatctggctggaagagagacaaattcacaaccttttgataatgagcaattattgaatactcactgaatttatcagagaaagtttaaaagtgtacgattatacatatttaccaggaatgtttaaacatagacatttatgaaatttatagaaaatattgaattgtggttctcactttttggtcttggctgtaacaatttttaaatattaatacttcctacaataactgtatcatgctatttttaagtgtcctcacactcaaccaatctactctgcatccataaaataagcatgcagttcagaaaatagattaaacgactaattggctaaaaa

SEQ ID NO: 26 - protein, 1261 aa, Homo sapiens
MIAHKQKKTKKKRAWASGQLSTDITTSEMGLKSLSSNSIFDPDYIKELVNDIRKFSHMLLYLKEAIFSDCFKEVIHIRLEELLRVLKSIMNKHQNLNSVDLQNAAEMLTAKVKAVNFTEVNEENKNDLFQEVFSSIETLAFTFGNILTNFLMGDVGNDSLLRLPVSRETKSFENVSVESVDSSSEKGNFSPLELDNVLLKNTDSIELALSYAKTWSKYTKNIVSWVEKKLNLELESTRNMVKLAEATRTNIGIQEFMPLQSLFTNALLNDIESSHLLQQTIAALQANKFVQPLLGRKNEMEKQRKEIKELWKQEQNKMLEAENALKKAKLLCMQRQDEYEKAKSSMFRAEEEHLSSSGGLAKNLNKQLEKKRRLEEEALQKVEEANELYKVCVTNVEERRNDLENTKREILAQLRTLVFQCDLTLKAVTVNLFHMQHLQAASLADSLQSLCDSAKLYDPGQEYSEFVKATNSTEEEKVDGNVNKHLNSSQPSGFGPANSLEDVVRLPDSSNKIEEDRCSNSADITGPSFIRSWTFGMFSDSESTGGSSESRSLDSESISPGDFHRKLPRTPSSGTMSSADDLDEREPPSPSETGPNSLGTFKKTLMSKAALTHKFRKLRSPTKCRDCEGIVVFQGVECEECLLVCHRKCLENLVIICGHQKLPGKIHLFGAEFTQVAKKEPDGIPFILKICASEIENRALCLQGIYRVCGNKIKTEKLCQALENGMHLVDISEFSSHDICDVLKLYLRQLPEPFILFRLYKEFIDLAKEIQHVNEEQETKKNSLEDKKWPNMCIEINRILLKSKDLLRQLPASNFNSLHFLIVHLKRVVDHAEENKMNSKNLGVIFGPSLIRPRPTTAPITISSLAEYSNQARLVEFLITYSQKIFDGSLQPQDVMCSIGVVDQGCFPKPLLSPEERDIERSMKSLFFSSKEDIHTSESESKIFERATSFEESERKQNALGKCDACLSDKAQLLLDQEAESASQKIEDGKTPKPLSLKSDRSTNNVERHTPRTKIRPVSLPVDRLLLASPPNERNGRNMGNVNLDKFCKNPAFEGVNRKDAATTVCSKFNGFDQQTLQKIQDKQYEQNSLTAKTTMIMPSALQEKGVTTSLQISGDHSINATQPSKPYAEPVRSVREASERRSSDSYPLAPVRAPRTLQPQHWTTFYKPHAPIISIRGNEEKPASPSAAVPPGTDHDPHGLVVKSMPDPDKASACPGQATGQPKEDSEELGLPDVNPMCQRPRLKRMQQFEDLEGEIPQFV

SEQ ID NO: 27 - DNA, 1858 bp, Homo sapiens
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaaaaaaaa

SEQ ID NO: 28 - protein, 553 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 29 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 30 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 31 - DNA, 1820 bp, Homo sapiens
gcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaaaaaaaaaaaaaaaaaaaaaaaaa

SEQ ID NO: 32 - protein, 227 aa, Homo sapiens
MGGKLSKKKKGYNVNDEKAKEKDKKAEGAATEEEGTPKESEPQAAAEPAEAKEGKEKPDQDAEGKAEEKEGEKDAAAAKEEAPKAEPEKTEGAAEAKAEPPKAPEQEQAAPGPAAGGEAPKAAEAAAAPAESAAPAAGEEPSKEEGEPKKTEAPAAPAAQETKSDGAPASDSKPGSSEAAPSSKETPAATEAPSSTPKAQGPAASAEEPKPVEAPAANSDQTVTVKE

SEQ ID NO: 33 - DNA, 2606 bp, Homo sapiens
aggacgccactgccctgtcgccccgcctgtgcagcccaggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggttagtggaccattctagaataccttgccatatttcttttcaactggctatttcccaaggatcatgtaagagaagctgggcagaaagataaaaagattacatcagtcatgattcatgaaccagtcatgaatcagttgacaacaaatttattgcacagaatatttctgtattttgtcaagctacttttaatatttaattcttttacttgataaaatgcaagtatattaagaaataagtatactgtgatgaattaatctatatatatgaacaaacctggtataaaatgaatgtaatctatgaacctttagagcttagactgtatttcacacaaataattgtcatgttttgttgctattgtgaattataaaaatgcagcatttaaaatttttaaggcaaaatttaataaaggatatacagt

SEQ ID NO: 34 - protein, 672 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYG

SEQ ID NO: 35 - DNA, 3718 bp, Homo sapiens
aggacgccactgccctgtcgccccgcctgtgcagcccaggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaattttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaaaaaaaaaaaaaaaaaa

SEQ ID NO: 36 - protein, 715 aa, Homo sapiens
MDLILNRMDYLQVGVTSQKTMKLIPASRHRATQKVVIGDHDGVVMCFGMKKGEAAAVFKTLPGPKIARLELGGVINTPQEKIFIAAASEIRGFTKRGKQFLSFETNLTESIKAMHISGSDLFLSASYIYNHYCDCKDQHYYLSGDKINDVICLPVERLSRITPVLACQDRVLRVLQGSDVMYAVEVPGPPTVLALHNGNGGDSGEDLLFGTSDGKLALIQITTSKPVRKWEIQNEKKRGGILCIDSFDIVGDGVKDLLVGRDDGMVEVYSFDNANEPVLRFDQMLSESVTSIQGGCVGKDSYDEIVVSTYSGWVTGLTTEPIHKESGPGEELKINQEMQNKISSLRNELEHLQYKVLQERENYQQSSQSSKAKSAVPSFGINDKFTLNKDDASYSLILEVQTAIDNVLIQSDVPIDLLDVDKNSAVVSFSSCDSESNDNFLLATYRCQADTTRLELKIRSIEGQYGTLQAYVTPRIQPKTCQVRQYHIKPLSLHQRTHFIDHDRPMNTLTLTGQFSFAEVHSWVVFCLPEVPEKPPAGECVTFYFQNTFLDTQLESTYRKGEGVFKSDNISTISILKDVLSKEATKRKINLNISYEINEVSVKHTLKLIHPKLEYQLLLAKKVQLIDALKELQIHEGNTNFLIPEYHCILEEADHLQEEYKKQPAHLERLYGMITDLFIDKFKFKGTNVKTKVPLLLEILDSYDQNALISFFDAA

SEQ ID NO: 37 - DNA, 1893 bp, Homo sapiens
gcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttgggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaa

SEQ ID NO: 38 - protein, 415 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKGCQGSRDACSPWEQVLAFAVAKTGCKLLQPQRNWPSSRGPPWRASEGERTAQ

SEQ ID NO: 39 - DNA, 1720 bp, Homo sapiens
gcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaaa

SEQ ID NO: 40 - protein, 383 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKAYFKTFVPQFQEAAFANGKL

SEQ ID NO: 41 - DNA, 1791 bp, Homo sapiens
gcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaa

SEQ ID NO: 42 - protein, 376 aa, Homo sapiens
MSPEVALNRISPMLSPFISSVVRNGKVGLDATNCLRITDLKSGCTSLTPGPNCDRFKLHIPYAGETLKWDIIFNAQYPELPPDFIFGEDAEFLPDPSALQNLASWNPSNPECLLLVVKELVQQYHQFQCSRLRESSRLMFEYQTLLEEPQYGENMEIYAGKKNNWTGEFSARFLLKLPVDFSNIPTYLLKDVNEDPGEDVALLSVSFEDTEATQVYPKLYLSPRIEHALGGSSALHIPAFPGGGCLIDYVPQVCHLLTNKVQYVIQGYHKRREYIAAFLSHFGTGVVEYDAEGFTKLTLLLMWKDFCFLVHIDLPLFFPRDQPTLTFQSVYHFTNSGQLYSQAQKNYPYSPRWDGNEMAKRAKRESNRDGEESSSA

SEQ ID NO: 43 - DNA, 1932 bp, Homo sapiens
ggaactgtcaggcaccgcggggacgcctttccgagcgcccggctcggcgcggcgcgggggcgcgcacgccgccgagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaaagagagagcaacagagatggggaggaatccagctctgcctgacatccaggcatcctctccaaattgcatagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaa

SEQ ID NO: 44 - protein, 376 aa, Homo sapiens; identical to SEQ ID NO: 42

SEQ ID NO: 45 - DNA, 1860 bp, Homo sapiens
ggaactgtcaggcaccgcggggacgcctttccgagcgcccggctcggcgcggcgcgggggcgcgcacgccgccgagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagaagcaagagataaagtaataatgggtactgtggggaaaaacacagaagaacaattcggtaatatagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcatgcacttggaggctcctcagctcttcatatcccagcttttccaggaggaggatgtctcattgattacgttcctcaagtatgccacctgctcaccaacaaggtgcagtacgtgattcaagggtatcacaaaagaagagagtatattgctgcttttctcagtcactttggcacaggtgtcgtggaatatgatgcagaaggctttacaaaactcactctgctgctgatgtggaaagatttttgttttcttgtacacattgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaaggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctgaaaaa

SEQ ID NO: 46 - protein, 383 aa, Homo sapiens; identical to SEQ ID NO: 40

SEQ ID NO: 47 - DNA, 1867 bp, Homo sapiens
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctgggaaaaaaaaaa

SEQ ID NO: 48 - protein, 419 aa, Homo sapiens
MNKHQKPVLTGQRFKTRKRDEKEKFEPTVFRDTLVQGLNEAGDDLEAVAKFLDSTGSRLDYRRYADTLFDILVAGSMLAPGGTRIDDGDKTKMTNHCVFSANEDHETIRNYAQVFNKLIRRYKYLEKAFEDEMKKLLLFLKAFSETEQTKLAMLSGILLGNGTLPATILTSLFTDSLVKEGIAASFAVKLFKAWMAEKDANSVTSSLRKANLDKRLLELFPVNRQSVDHFAKYFTDAGLKELSDFLRVQQSLGTRKELQKELQERLSQECPIKEVVLYVKEEMKRNDLPETAVIGLLWTCIMNAVEWNKKEELVAEQALKHLKQYAPLLAVFSSQGQSELILLQKVQEYCYDNIHFMKAFQKIVVLFYKADVLSEEAILKWYKEAHVAKGKSVFLDQMKKFVEWLQNAEEESESEGEEN

SEQ ID NO: 49 - DNA, 2213 bp, Homo sapiens
gagtcctcctttttgcacacacacgaatacaaagagccatacgaccttcggtttcaggtttagctgtgcctcccagtgactataatgacaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcaaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataaaaaaaaaaaaaaaaaaaa

SEQ ID NO: 50 - protein, 538 aa, Homo sapiens
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 51 - DNA, 2134 bp, Homo sapiens
gagtcctcctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcaaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataaaaaaaaaaaaaaaaaaaa

SEQ ID NO: 52 - protein, 538 aa, Homo sapiens; identical to SEQ ID NO: 50

SEQ ID NO: 53 - DNA, 2380 bp, Homo sapiens
gagtcctcctttttgcacacacacgaatacaaagagccatacgaccttcggatgccggaaggtccttctgaatcccttccctgttccttaggttgcactagtcgggggttccatgctggggggcagaaggaatgctctctaccgtctgaaaccgttcatcaggaaggccttgatttgtgatgtgctaggagagcacaggatctgcaaatagaaggcacctgtctcccttctgcaggccgaggagaggccgccatggactgtgtgcttcttcatggcttgtttactcttctttcacagaccctacagcttggggcctgggctcctctgaccatcctcattgagaaaggaaagtgagtccagagaagttgatgcttcctacctgttggagcggcccagcagtgtaagcgtggttgttactgccccatccgccatgtccttcagtgccaccattctcttctcccctcccagtggcagcgaggccagatgctgctgctgcgcctgtaagagtgagactaatggaggcaacacaggctcccagggtgggaatcctcctcccagcacccccatcacagtgactggacatggcttggctgttcagagctcagagcagctcctgcatgttatctaccagcgggtcgataaggcagtgggtttggctgaagctgctctgggtcttgccagggccaacaatgagttgttaaaacgtctccaggaggaagtgggtgacctgaggcaagggaaagtgtccatccctgatgaagatggggaaagccgggcacatagttccccacctgaggagcctgggcctctcaaggaaagtcccggggaagcctttaaggctctgtctgccgtggaagaggagtgtgacagcgtgggcagcggcgtgcaggtggtgattgaggagctgcggcagctgggagcagcctcagtggggcctgggcctttgggcttcccagcaactcagagggacatgcggctcccagggtgcacgctggctgccagcgaggcggcccccctgctcaatcctctggtggatgattacgtggcctctgagggtgcagtacagcgagttctggtccctgcttatgccaagcaactctcaccagccacacaactggcaatccagcgggcaaccccagagacaggaccagaaaatggaaccaagctgccaccaccccgccctgaggacatgctcaatgccgctgctgcgctggacagtgccttggaagagtcaggccctgggagcactggggagctgagacactctctagggctgaccgtttccccatgcaggaccagaggaagtgggcagaagaactccaggcgcaagcgggatcttgtactctctaaactggtccacaatgtgcataaccacatcaccaatgacaagagattcaatgggtctgaaagcatcaagtcctcttggaatatttcagtagtgaagtttcttctggaaaagctcaagcaagagctggtgaccagtccccacaattacactgataaggagctaaaaggagcctgtgtggcctacttccttactaagaggcgtgagtaccgcaactccctgaacccctttaaaggcctgaaggaaaaagaggagaagaaacttcgaagtcgccgatatcggctttttgccaaccgatccagtatcatgaggcattttggacctgaggaccaacgtctgtggaatgatgtgacagaggaactgatgtcagatgaagaggacagtcttaacgagccaggtgtgtgggtggcccgccctccccgtttccgggcccagcgcctcacagagctctgctaccacctggatgctaactctaagcatggcaccaaagccaaccgtgtgtatgggcctccctcagacagactgccttctgctgaagcccagctccttccaccagaactttacaatcctaatttccaagaagaggaagatgagggaggggatgagaatgcacctggctccccatcttttgaccaaccccacaaaacctgctgtcctgacttgaactcattcattgaaatcaaggtggaaaaggatgaataaaatctacagccaagaataactctggcttccgccatgccccatgtctcagaaataggtggccatggggcttcacaaaataatgagatgctctgtgcagtctgagaaagcaaatttgcctcttttcttaacacagtctctactggggaagcagaacactggtgggataaaaacttatctagaaggggagaaactccctccactgtgaacagtaagccagaatatgcttattcctcagcataaacagtatctcggagaagcctgggatgagaaaatgaggaggatgggtccaagaaacatgaggccttcttgacataaaaaaaaaaaaaaaaaaaa

SEQ ID NO: 54 - protein, 538 aa, Homo sapiens; identical to SEQ ID NO: 50

SEQ ID NO: 55 - DNA, 1303 bp, Homo sapiens
gaagagacagcgccgccggccgtggggagcggacgcagtgatttgctccccctcgtgcagcaacccccacacccagcaccaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaagaaaaaaaaaaaaaaaaaaa

SEQ ID NO: 56 - protein, 57 aa, Homo sapiens
MGWEGPNSRVDDTFWASWRAFAQIGPARSGFRLETLAGLRSRRLKQPKAFCLRDVAP

SEQ ID NO: 57 - DNA, 1385 bp, Homo sapiens
aagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataatttaagaaaaaaaaaaaaaaaaaaa

SEQ ID NO: 58 - protein, 57 aa, Homo sapiens; identical to SEQ ID NO: 56

SEQ ID NO: 59 - DNA, 5360 bp, Homo sapiens
aagatgcagttccacctcccagattccctagttactatctctaagcactgaagtcggtgtttggagaaaaggactcaggtgaggactggagcctaacagatgagacagaatataaacaggaagtctctaaggcagtgtggtggaaggataataccatgatggaggaagtgcacagtattatgggagaacatagcagtggcatctgaccaattttaagggaatccaggacagctttcctgaagctgaagaaagagtaaaagccaggcttatcaaagttttggctttgttgcaagagcaggtcaagatttagctgttcttcagtgaacaagtgtgcagattgtcaaatatgtcagttcatcaaataagaaaacatgcagttctcccacctatcatttgtagaagtgacaaggaatttttggaaagtgtgcaaagatacataattacagaaactgaaagactgggctgtagtgaggaaggacctgctgatgaatattacatcatataccgaaatgtttttgataaggtaatagagcatatcactgcatacaaatccattcttacttcaatcaaaaaagaatatgatgcctttattgagacaataaagaaagaccgaagaactacattttgtcttcatggaaaacttaaaggtttggcagcagagcctacagctttggtatattacaggaaaagaacaatccaacttgaagcaaaaatgaggattatcgaaagtaattcctcgaagattcaatctcaaatagatcacatcaagcagtgtagggcagagtatgacacaaaagaagtaaaatattgtactttctccaaagatccttcaaaacctattccaggcatgactcttcaagaatccatgaatctagatgctctcactaaatacatgaaacatcttgaagataaatatgcagaaattaaacaagctatgttgataaaatatgtgccagctcagaggaaggctgatttagatgaagaaatgattgtgttattaaaacggcgagatgtagctgaaaatctgaacaaaaaattgcagttttgtcatcaaagactgcagataatttcacaggcacttagttcatgggtaaaatctgatatgagcagcccatttcaagactttgtggagcaaattcagaaaaccaaatatttacaaggtgaccaaggcattgttgaagaactaatggaagatgatccacgcagggcaaaagaagctgaaattatgcttcactacattgaaaggtttaatgagttaatctcacttggtgaatatgaaaaggcagcttgttatgcagcaaacagtcctagaagaattcttcgaaacattggtacaatgaatacatttaaggctgttggaaaaattagaggaaagcctcttccattactcttattttttgaggccctctttatcacaagtcatgcttttccatgtcctgttgatgcagctctaaccctggaaggaatcaaatgtggattatcagaaaaacggttagatttagttaccaattgggttacacaggaaagactgacattttctgaggaggctggggatgtgatttgtgattatggggagcaggatacttataacaaggccaagtgcctggctttagctcagattgtctacagtgaatgtggcctgcacaagaaagctattctttgcttgtgtaaacagggtcagactcatagggtcatggagtacatacagcagttgaaggactttactaccgatgacctgttgcagctattaatgtcatgtccccaagttgaattaattcagtgtctcactaaagagttgaatgagaaacaaccatctttatcttttggtcttgctatacttcatctgttctctgcagacatgaaaaaagttggcattaagctacttcaagaaatcaataaaggtgggatagatgcagtagaaagtcttatgataaatgattccttttgctccatagaaaagtggcaagaagtggcaaatatatgttcacagaatggctttgacaaattatctaatgacatcacgtctattcttcgatctcaggctgcagttacagaaatttctgaagaggatgacgcagtcaacctaatggaacatgtgttttggtagttctatatcttaaccagctgagggagcttgtacaacaccttatgtatgctggttgggaaaaactgattttaacgtaactaacttataaataaatctagagtaagaagatctcagaaataaatcacacttttgttatgatgacatttagatttgtctttgaaatatttatactattgcttccttttccccatatggtcatttcttatattgaatcttgataaaatccaagattataactttgtgtgaaacagtgtagggcatttttatctaaggacataagctaatgtccagatatattactttctggtgatgtaatatgatagcaagaactgaggaaggtgtgggtagtatcctgtgtgttagactgtcttcccaaacatgaaatgctacaagcctgacttgaccagaaaagcaggaaatcatttcaaggttggacttgctggcaaaaacctagagtatagtaattttgtactgctgatttaaagatgcgccccatgctttgatatatataaatatggcaaagcttaggcttctagtataaaagctgggactcttggcatgttattacttagagagaagaccagtcgaattttgcatagaagtagacctgtgatacctataggtatggaaaatatgtcataagaagtggttttggattatttcaagtgtctgaataagtatttgattgaaaactctgaaagttctgtgccatggacaggtgtaatattaaaaatatttaatgattagtatggcatgggcacaaatcaagcagaacagatacctaattaatcagaacagcctttagcccttatgccacaccagagcttactagctaaatgtcatccttgaccatggaacatggttaaaatgagctgctggctgggcaaggtagctcatgtctgtaatcccagcactttgggaggtcgaggcaggaggatcgcttgagcccaggagtttgagaccagctaggtaacacagtgagatcccgtctctgttattaaaaaaagaaaaaaaaatttcaagtaaaaaatgaaaatgatctgctattagaataagagcaaagagcataacttttcccatcctaaatttaaattgaatatgtatttttatgttatagtggaaagaagatgaacggggagtcagacagcttcatattaaaattctggtcctacctcttactcacttataaaatatgggcagtcttccttaggcttgttgtgaggattagtgataatgtatgtgtagtgtaagtgtataacatgatagaggaacttaggaaaagatagctgtaattcctttgtaatcggccccagaaacacacatttctctacttagtttgtacttactaaatcccatatgtctactcatttgtatttatatgtttatccttctttaaagtatttgatatattggtacaacttattgctgagattaagttatctgtccacacttgtattagggttgcctggcttatcttataaattcagaagcattcaagctgagtttttaatttttccatttggtgctaaatagaatactggataattataattcagctttctaaaacgtagcatttttaaagtaatacatgtgcatagtttaaaaagcaatttattactaaaagccttatcaaaataatattttgatttttggccttcatacaggctgttgaaaagagcagataaaggatggaaaaaaggaatggaaagggagaggtatttcggcagcactggttctttgtgtgccaacggcttaaaacctttttttttttttttttcctttgagacctatatgattgatagaaagctattatgtgtccattgacagagcttagaaaaaaaaatgtcttcatgaaagccaggaggataaagtaggtatataaatctagagaaagcttaaacagcggttgttgttgttattctaattttgccttgtttttccttttctcattattactccttctcagttagcattgcctttggcagctttcccaaggaaagtaaaagttgtcaagtgaatataaattaaaatgcctggtgatggaaaatggagttgggaggaagagcaagattacaaagttaaatgaggaaggagaaagaattgagttgtgagctacagagggctttgaagctataagagcctccatgtaagctacactgaaggaggtataatctgggcctcagcacagaaacctgcattctagaccagccccaccactgtctagctatgtgtccttttcctcatgcttaagataaatttattttgactagatacctcctcttgtcatttccaactctaaaattcagtaattctgaaaaggtacaaattatttcccaatgcttcttgaccttcagcctaaatttcaaatactacaattcaacatcagcatcaacaacatctaccgaatacctgttttgcacacaatttctgctagcaagattacaaccttaatggaaacacacaacgtattttaaaagttactaataataattccttagcattatctaatagccagtccatattcaaatttcaccagttgctaaaaatgccttttaacatttgaattgttccaatgaagatttaaccaacgttcatgtgttctattaggtcttgctgtcttgagcgtgtcttctctccttttttcctcttgccattgattgctttacatagcagttgcaaagcaagggtcatgatgaactaagtttctctgatttcatattaggttttctttctaccataccagtgaggaaaggaagatatttcttccaaggtctgaaagatttaattgtaactagttacatttttgtttattatagtcaagcatgtatcaaaatgaatttctattaaattcattcatttggaaaggtttagagatgttgaacagaagtctagtctaatgaaaaaaatttttttaatatttagaacttttcctaaatcctgaattaactaagaaatgaccattaaattaatcacttttttaactttaaaaggtgaaaacctgttactttttaggtgcctggaattctgttggattgctaaagcatatgttaagtcaaaaatcatagcagaggcctttttttttttttttaactttgtacatttcatagaaagctcatacatttcttccattctttctcagaaaaaaatggcatttaacaaatgttcggtgtataaagctgtcagtttgctagtagttataatttgttgtgttcttgaataaaaatatattgggtacataaaaaaaaaaaaaaaa

SEQ ID NO: 60 - protein, 586 aa, Homo sapiens
MSVHQIRKHAVLPPIICRSDKEFLESVQRYIITETERLGCSEEGPADEYYIIYRNVFDKVIEHITAYKSILTSIKKEYDAFIETIKKDRRTTFCLHGKLKGLAAEPTALVYYRKRTIQLEAKMRIIESNSSKIQSQIDHIKQCRAEYDTKEVKYCTFSKDPSKPIPGMTLQESMNLDALTKYMKHLEDKYAEIKQAMLIKYVPAQRKADLDEEMIVLLKRRDVAENLNKKLQFCHQRLQIISQALSSWVKSDMSSPFQDFVEQIQKTKYLQGDQGIVEELMEDDPRRAKEAEIMLHYIERFNELISLGEYEKAACYAANSPRRILRNIGTMNTFKAVGKIRGKPLPLLLFFEALFITSHAFPCPVDAALTLEGIKCGLSEKRLDLVTNWVTQERLTFSEEAGDVICDYGEQDTYNKAKCLALAQIVYSECGLHKKAILCLCKQGQTHRVMEYIQQLKDFTTDDLLQLLMSCPQVELIQCLTKELNEKQPSLSFGLAILHLFSADMKKVGIKLLQEINKGGIDAVESLMINDSFCSIEKWQEVANICSQNGFDKLSNDITSILRSQAAVTEISEEDDAVNLMEHVFW

SEQ ID NO: 61 - DNA, 1279 bp, Homo sapiens
ctttcagttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggcactgaagaacctggcacagctgaacgacatccaccagcagtacaagatccttgatgtcatgctcaaggggctctttaaggtgctggaggactcccggacagtgctcaccgctgctgatgtgctcccagatgggcccttcccccaggacgagaagctgaaggatgctttctcccacgtggtggagaacacggccttcttcggcgatgtggtgctgcgcttcccgaggattgtgcactattactttgaccacaactccaactggaacctcctcatccgctggggtatcagtttctgcaaccagacaggcgtcttcaaccaggggccccactcgcccatcctcagcctgatggcccaggagctggggatcagtgagaaagactccaacttccagaacccatttaaaatcgaccgcacagagttcattcccagcactgaccctttccagaaggccctgagagaagaagagaaacgccgaaagaaagaggagaagcggaaggagatccgaaaaggcccaaggatctccagatcccagtctgagttatagccctggagcagctcagggctcagggggccacaaggaggcaggtcgggaggaagaagaggtggaggtgtggttgtggtggagagcaccagctagccccttccagaaggggaggccacatttgcccggccccctggagctgggtctgagccccagctgaagggactgagcctcagatggctggattttctctcaggggcctcctgctgaaggggccttcagaggattttatgctggaaatatgaccctgtgcagactgctgggggaggcaggaggatgcctgcctggaccctgttggtggctgaagacctctggccagctggcttccgcccttggtggggaagcagcagaactaggttctgagccacgggtcagggtgccaccctgctgctggccccactgtgtcacagagctgcctggcacaggtcccagcccctctgcagagacacaataaaagccagcagaccctttggaccgacaaaa

SEQ ID NO: 62 - protein, 229 aa, Homo sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 63 - DNA, 2811 bp, Homo sapiens
ccatttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttaccttaaaaaaaaaaaaaa

SEQ ID NO: 64 - protein, 432 aa, Homo sapiens
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 65 - DNA, 913 bp, Homo sapiens
ccagagaggggcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggcgtagtggtggcaggacaagagaaggcattgagctttttctttcattttcctattaaaaaatacaaaaatca

SEQ ID NO: 66 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 67 - DNA, 6910 bp, Homo sapiens
gggcaagctggaaaagcgtgtgggtgagaccctcgcacaaccccttttcattgtctgtgtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaactttaaaaaaaaaaaaaaaaaaaaa

SEQ ID NO: 68 - protein, 1486 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 69 - DNA, 6832 bp, Homo sapiens
gggcaagctggaaaagcgtgtgggtgagaccctcgcacaaccccttttcattgtctgtgtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaactttaaaaaaaaaaaaaaaaaaaaa

SEQ ID NO: 70 - protein, 1460 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASALKTTRLQSAGSAMPTSSSFKHRIKEQEDYIRDWTAHREEIARISQDLALIAREINDVAGEIDSVTSSGTAPSTTVSTAATTPGSAIDTREEVGDLHGEMHKLVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 71 - DNA, 7204 bp, Homo sapiens
gggcaagctggaaaagcgtgtgggtgagaccctcgcacaaccccttttcattgtctgtgtgtggcgcctgcgcagtaagggatcgttggaactgggcaggaggggatagggtccggctcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcggcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaactttaaaaaaaaaaaaaaaaaaaaa

SEQ ID NO: 72 - protein, 1584 aa, Homo sapiens
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 73 - DNA, 2193 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 74 - protein, 253 aa, Homo sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 75 - DNA, 2237 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 76 - protein, 276 aa, Homo sapiens
MGGDRLENKTSVSVASWSSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 77 - DNA, 2188 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 78 - protein, 253 aa, Homo sapiens; identical to SEQ ID NO: 74

SEQ ID NO: 79 - DNA, 2500 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcggtgagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 80 - protein, 253 aa, Homo sapiens; identical to SEQ ID NO: 74

SEQ ID NO: 81 - DNA, 1883 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 82 - protein, 158 aa, Homo sapiens
MGESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 83 - DNA, 2244 bp, Homo sapiens
tatcgccgcctcagacagctttcagtctgtccctcctacaactcccacaaggcccctcggccccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtaaaaaaaaaa

SEQ ID NO: 84 - protein, 253 aa, Homo sapiens; identical to SEQ ID NO: 74

SEQ ID NO: 85 - DNA, 4452 bp, Homo sapiens
ttattttccccggagagtcccgaggcgccgcgccttggccctgcctacagcccgaggccccgcccccggcgcccctcccagccgtttgaagcggctcgggctgcggctggctcagagtggcgcggggggcgtggggcggtgctgaggagctgaagccgtggccagctcgacgccggacagtccagcgagcagcacggcgggaaccggcagccggagcagtcccggagcagaagcagcagcagcagcagcagccctcgccgttcgcggagcgcagccgagccggccatggcgttgtcgatgccgctgaatgggctgaaggaggaggacaaagagcccctcatcgagctcttcgtcaaggctggcagtgatggtgaaagcataggaaactgccccttttcccagaggctcttcatgattctttggctcaaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttgtaaaagagatgtcttcatgtcttcccctaagaatacgcttttcctaacaggctactccttcctgtagagcagaaattgtattttgcacgaacatgcagttattgaagattaggatcaaggatagacaaggtatagtagttatcttaaaatatacactcctaagcagtattattttaaaatcctttaccctggctacctcccctacccgggttcccctctctttaatttggagacactccaccacaaacttttcactttagaggtagcttgccatctctcaggagccctcaccattgtgtccattcactgtgtatagatggcagaacttttgaggtgcaatgtttaattgttaaaaatagtagccacgactttatcaggcagccccaaactggtgcataatgcatggtacaagaaatatttatgtattttttggaattttgtaatatttagtaagagtatatgaaaggattgctactgtatcagaaatattgtttcaatttagtctatcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacgacccagcaacatgctttaaccccattgtatgtttgtggaaagagcatagtttaacatcttgagaaatttgggacataaagttttcatggtagacagttcatgcagtatatgaattgccataatggaaataatctgattttatttttacaactaacatccattccccttcatttaaacaccttttgtgttttacttcagtgaggagattggagtctgaatggatctgttttccaagagattctgagaaatttttgtattcagcagttggaaagctctctattctagttgataaaacttcccttttttgatgtagatgcagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatgcatgtattttcttttatctttggaacatcagcaccagtatattgctggcagctattgtattaaaaaataaagtatattttcactatcataaaggattcttttttcccccctcatgaaaataaacaacaacttggggtaaaagtgaaaaaaaaaaaaaaaaaa

SEQ ID NO: 86 - protein, 253 aa, Homo sapiens
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 87 - DNA, 5398 bp, Homo sapiens
cgcggcggaggaggcagcatcccgcggcgctgacggtcctggggagagcatggcgccgaggtgcccctggccatggccgcggcggcggcgcctcctggacgtgctcgcgcccctggtcctgctgctcggggtccgcgcggcctccgcggagccagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 88 - protein, 1336 aa, Homo sapiens
MAPRCPWPWPRRRRLLDVLAPLVLLLGVRAASAEPERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 89 - DNA, 5910 bp, Homo sapiens
agctccagccgcactgccccgatggctccctacccctgtggctgccacatcctgctgctgctcttctgctgcctggcggctgcccgggccaacctgctgaacctgaactggctttggttcaataatgaggacaccagccatgcagctaccacgatccctgagccccaggggcccctgcctgtgcagcccacagcagataccaccacacacgtgaccccccggaatggttccacagagccagcgacagcccctggcagccctgagccaccctcagagctgctggaagatggccaggacacccccacttctgccgagagcccggacgcgccagaggagaacattgccggtgtcggagccgagatcctgaacgtggccaaaggcatccggagcttcgtccagctgtggaatgacactgtccccactgagagcttggccagggcggaaaccctggtcctggagactcctgtgggcccccttgccctcgctgggccttccagcaccccccaggagaatgggaccactctctggcccagccgtggcattcctagctctccgggcgcccacacaaccgaggctggcaccttgcctgcacccaccccatcgcctccctccctgggcaggccctgggcaccactcacggggccctcagtgccaccaccatcttcagagcgcatcagcgaggaggtggggctgctgcagctccttggggaccccccgccccagcaggtcacccagacggatgaccccgacgtcgggctggcctacgtctttgggccagatgccaacagtggccaagtggcccggtaccacttccccagcctcttcttccgtgacttctcactgctgttccacatccggccagccacagagggcccaggggtgctgttcgccatcacggactcggcgcaggccatggtcttgctgggcgtgaagctctctggggtgcaggacgggcaccaggacatctccctgctctacacagaaccaggtgcaggccagacccacacagccgccagcttccggctccccgccttcgtcggccagtggacacacttagccctcagtgtggcaggtggctttgtggccctctacgtggactgtgaggagttccagagaatgccgcttgctcggtcctcacggggcctggagctggagcctggcgccgggctcttcgtggctcaggcggggggagcggaccctgacaagttccagggggtgatcgctgagctgaaggtgcgcagggacccccaggtgagccccatgcactgcctggacgaggaaggcgatgactcagatggggcatccggagactctggcagcgggctcggggacgcccgggagcttctcagggaggagacgggcgcggccctaaaacccaggctccccgcgccaccccccgtcaccacgccacccttggctggaggcagcagcacggaagattccagaagtgaagaagtcgaggagcagaccacggtggcttcgttaggagctcagacacttcctggctcagattctgtctccacgtgggacgggagtgtccggacccctgggggccgcgtgaaagagggcggcctgaaggggcagaaaggggagccaggtgttccgggcccacctggccgggcaggccccccaggatccccatgcctacctggtcccccgggtctcccgtgcccagtgagtcccctgggtcctgcaggcccagcgttgcaaactgtccccggaccacaaggacccccagggcctccggggagggacggcacccctggaagggacggcgagccgggcgaccccggtgaagacggaaagccgggcgacaccgggccacaaggcttccccgggactccaggggacgtaggtcccaagggcgacaagggagaccctggggttggagagagagggcccccaggaccccaagggcctccagggcccccaggaccctccttcagacacgacaagctgaccttcattgacatggagggatctggcttcgggggcgatctggaggccctgcggggtcctcgaggcttccctggacctcccggaccccccggtgtcccaggcctgcccggcgagccaggccgctttggggtgaacagctccgacgtcccaggacccgccggccttcctggtgtgcctgggcgcgagggtccccccgggtttcctggcctcccgggacccccaggccctccgggaagagaggggcccccaggaaggactgggcagaaaggcagcctgggtgaagcaggcgccccaggacataaggggagcaagggagcccccggtcctgctggtgctcgtggggagagcggcctggcaggagcccccggacctgctggaccaccaggcccccctgggccccctgggcccccaggaccaggactccccgctggatttgatgacatggaaggctccggggggcccttctggtcaacagcccgaagcgctgatgggccacagggacctcccggcctgccgggacttaagggggatcctggcgtgcctgggctgccgggggcgaagggagaagttggagcagatggagtccccgggttccccggcctccctggcagagagggcattgctgggccccaggggccaaagggagacagaggcagccggggagaaaagggagatccagggaaggacggagtcgggcagccgggcctccctggcccccccggacccccgggacctgtggtctacgtgtcggagcaggacggatccgtcctgagcgtgccgggacctgagggccggccgggtttcgcaggctttcccggacctgcaggacccaagggcaacctgggctctaagggcgaacgaggctccccgggacccaagggtgagaagggtgaaccgggcagcatcttcagccccgacggcggtgccctgggccctgcccagaaaggagccaagggagagccgggcttccgaggacccccgggtccatacggacggccggggtacaagggagagattggctttcctggacggccgggtcgccccgggatgaacggattgaaaggagagaaaggggagccgggagatgccagccttggatttggcatgaggggaatgcccggccccccaggacctccagggcccccaggccctccagggactcctgtttacgacagcaatgtgtttgctgagtccagccgccccgggcctccaggattgccagggaatcagggccctccaggacccaagggcgccaaaggagaagtgggcccccccggaccaccagggcagtttccgtttgactttcttcagttggaggctgaaatgaagggggagaagggagaccgaggtgatgcaggacagaaaggcgaaaggggggagcccgggggcggcggtttcttcggctccagcctgcccggcccccccggccccccaggcccacgtggctaccctgggattccaggtcccaagggagagagcatccggggccagcccggcccacctggacctcagggaccccccggcatcggctacgaggggcgccagggccctcccggccccccaggccccccagggcccccttcatttcctggccctcacaggcagactatcagcgttcccggccctccgggcccccctgggccccctgggccccctggaaccatgggcgcctcctcaggggtgaggctctgggctacacgccaggccatgctgggccaggtgcacgaggttcccgagggctggctcatcttcgtggccgagcaggaggagctctacgtccgcgtgcagaacgggttccggaaggtccagctggaggcccggacaccactcccacgagggacggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtagccaccgcctggatgcggatggccggagaggaccggcggctcggaggaagcccccaccgtgggcagggagcggccggccagcccctggccccaggacctggctgccatactttcctgtatagttcacgtttcatgtaatcctcaagaaataaaaggaagccaaagagtgtatttttttaaaagtttaaaacagaagcctgatgctgacattcacctgccccaactctcccctgacctgtgagcccagctgggtcaggcagggtgcagtatcatgccctgtgcaacctcttggcctgatcagaccacggctcgatttctccaggatttcctgctttgggaagccgtgctcgccccagcaggtgctgacttcatctcccacctagcagcaccgttctgtgcacaaaacccagacctgttagcagacaggccccgtgaggcaatgggagctgaggccacactcagcacaaggccatctgggctcctccagggtgtgtgctcgccctgcggtagatgggagggaggctcaggtccctggggctagggggagccccttctgctcagctctgggccattctccacagcaaccccaggctgaagcaggttcccaagctcagaggcgcactgtgacccccagctccggcctgtcctccaacaccaagcacagcagcctggggctggcctcccaaatgagccatgagatgatacatccaaagcagacagctccaccctggccgagtccaagctgggagattcaagggacccatgagttggggtctggcagcctcccatccagggcccccatctcatgcccctggctgggacgtggctcagccagcacttgtccagctgagcgccaggatggaacacggccacatcaaagaggctgaggctggcacaggacatgcggtagccagcacacagggcagtgagggagggctgtcatctgtgcactgcccatggacaggctggctccagatgcagggcagtcattggctgtctcctaggaaacccatatccttaccctccttgggactgaaggggaaccccggggtgcccacaggccgccctgcgggtgaacaaagcagccacgaggtgcaacaaggtcctctgtcagtcacagccacccctgagatccggcaacatcaacccgagtcattcgttctgtggagggacaagtggactcagggcagcgccaggctgaccacagcacagccaacacgcacctgcctcaggactgcgacgaaaccggtggggctggttctgtaattgtgtgtgatgtgaagccaattcagacaggcaaataaaagtgaccttttacactgaaaaaaaaaaaaaaaaa

SEQ ID NO: 90 - protein, 1516 aa, Homo sapiens
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 91 - DNA, 874 bp, Homo sapiens
gaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 92 - DNA, 2768 bp, Homo sapiens
ggagctttgctgaaactgcacaaaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagcagagaaccaattctggagaacagcctcacttctttgattgaatacttacataatgcattggaacatgacatgagattaaggtttaataatgatagaatgaagaccacaataaaagagacctctacttagctcagcaattcttacctttcttacctatttgatgaagatgtcttttgaaaggtgtactgcaaggaacaaaatgtttgtaaattctccttttaccaaggtggataattactgtaccttcctcatggaaaaagttttatttaaagtgttatttctcattgaatactatcaaaaaggaaaaaaaaatgacctaaacttttgagatagatttggctctaggcctactctaggtgcggtacttcactatagtttataaaagatggtccctgtcagcaaagaactgtaacctgtatgagaatattatactaacatacaagaaacaagtagagaataatggaatgtaaactctggcttgctaacttaagtgtggtagaagcttgaaggaaatgtggacttaaacttatcagagaagacttataagaggatatgaaaggtgtaaattttgataccaccattgccgccttcccctcaaaaaaggtgagaactgactaaactactggtacttagaccatgtggagaaggaactgaaaatggaaacagaaacacgtctgtacagagcagagtgtcagataatagctcattttagtagagggcaataaatgccacatgagatgatcacctcagcagaaaactgggatgtggagacgctggtagcggggccaggaaggctccggacggagcaggttttctggaccacagacacactgccccggcgccctccgcaggccgctcctccccaggcccatgacagtgccccgctggtttctgccgcgctgccggactggagctcagacggccttcgccagcccccccaacccacgcagatccctgctgacctgggcaactccccaccctcgctgaaggttcgaggaccaccccgctttcccgagaggagccgggcggcgggtacttatctccgacctccggctagtgggaaaggccgcgcgaccgcccgtcctccaactacagggaccgcacgaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaaacttctaaaaatttgctgttgagaccagctgaaatgtttgaaagaagcaactaaagaaagaaactttgaaagaagcttccaaaagaagcaaccaagtctacaaaggcacagtttgactcaaatggatccaactgattagcaaatggaaaataacatggaggaatatattttgcatgacaagcatagcagctccaagtcatccctaatgaagccaaaaatttaagtgcaacccagagaatggatggttcagaatcttttttttttttgagatggagtctcgctctgtcacctaggctggagtgcggtggcatgatctcggctcactgcaagctccgcctcctgggttcacgccattctcctgcctcagccttccgggtagctgggactacaggtgcctgccaccacgcccggctaattttttgtatttttagtagagacggggtttcaccgtgttagctaggatggtctcaatctcctgacctcgtgatctgcccgcctcagcctcccaaagtgctggaattacaggcgtgagccaccgcgcccggcccagaatcttttttaaattttttattattattattttttctgagatggagtccggctctgtggccaggctggagtgcagtggcacaatctcagctcactgcaacctctgactcccaggtacaagtgattctcctgcctcagcctcctgagtagctgggataacaggcacgtgccaccacgcccagctaatttttgtatttttagtagagacggggtttcaccatgttggccaggatggtctcgatctgcctaccttggcctcccaatgtactgggattacaggcgtgagccaccgtacccggcccagaatctttgccttttgtttgcatagtttaatcttctaaaccagttgctttcccagaaaaggtgacttaaagtcatagcctttgtgttcatcaccatactctccatagttttacaaattattcagtttatttttaaaaggggtaatttttaaaatttttatttttaattccgaagcattccttttaatacattctcttgagggaaaaaaaaaatcacacatagtgattgtgtgtggtagtgattatgtgtggcctaagtggcaattgatcaataccccaatctcaagcctgtacattgttactggttgactggttggttgcctggtgggctttttgtccttccagatgtttttctaccttctgccttttccaataaagcttccattat

SEQ ID NO: 93 - DNA, 4052 bp, Homo sapiens
aagtaagtgcgatggaaccttcaggttccaaccgccgccagggccgctccgcccagtggagcctgtccggcccccttgctgcccgctagctcccgccggctggcgcaagctgtcggcgccggggcactgcgggcggggtcggagcctggccttcctgacgttgcagctgccgtccccgcacgttccggccagggcctccctcttagggccgggcggtgcccgtggctcaggctgcagagtagaaagcacaaaaaccagcctgattgtatctggaaaaaaccattatgttacagttgataggctcaccccaaaatatgcttttggggactgatttagcacctgcatattctgcgtgaatctctttaattggttgcagttgagctaatggtggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaagatgcaaaaaaaaaaaaaaaa

SEQ ID NO: 94 - protein, 760 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 95 - DNA, 1326 bp, Homo sapiens
ccgcccctctgccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaata

SEQ ID NO: 96 - protein, 113 aa, Homo sapiens
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 97 - DNA, 3818 bp, Homo sapiens
caggaactgggccagctccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaaaaaaaaaaaaaaaaaaaaaaaaaaaaaaaaaaaaaaaaaaa

SEQ ID NO: 98 - protein, 733 aa, Homo sapiens
MGWMGEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 99 - DNA, 4007 bp, Homo sapiens
gccaaggcggccggctggagggacggggcccgaccgggagcggagccggagcggaagccgcagccgggcggcgggagcggcgggagcggcgggagcgggggaagcagggcgggccgggctccatggcgccagcggcgtccgcctgagcagcgcgggcaacagcggcggcgtcggccggatcgggccgcgacacctcctggccatgggggacgtgctgtccacgcacctggacgacgcccggcgccagcacatcgcagaaaaaaccgggaagatcctgacggagttcctccagttctatgaagaccagtatggcgtggctctcttcaacagcatgcgccatgagattgagggcacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaaaaaaaaaaaaaaaaaaaaaaaaaaaaaaaaaaaaaaaaaaa

SEQ ID NO: 100 - protein, 746 aa, Homo sapiens
MGDVLSTHLDDARRQHIAEKTGKILTEFLQFYEDQYGVALFNSMRHEIEGTGLPQAQLLWRKVPLDERIVFSGNLFQHQEDSKKWRNRFSLVPHNYGLVLYENKAAYERQVPPRAVINSAGYKILTSVDQYLELIGNSLPGTTAKSGSAPILKCPTQFPLILWHPYARHYYFCMMTEAEQDKWQAVLQDCIRHCNNGIPEDSKVEGPAFTDAIRMYRQSKELYGTWEMLCGNEVQILSNLVMEELGPELKAELGPRLKGKPQERQRQWIQISDAVYHMVYEQAKARFEEVLSKVQQVQPAMQAVIRTDMDQIITSKEHLASKIRAFILPKAEVCVRNHVQPYIPSILEALMVPTSQGFTEVRDVFFKEVTDMNLNVINEGGIDKLGEYMEKLSRLAYHPLKMQSCYEKMESLRLDGLQQRFDVSSTSVFKQRAQIHMREQMDNAVYTFETLLHQELGKGPTKEELCKSIQRVLERVLKKYDYDSSSVRKRFFREALLQISIPFLLKKLAPTCKSELPRFQELIFEDFARFILVENTYEEVVLQTVMKDILQAVKEAAVQRKHNLYRDSMVMHNSDPNLHLLAEGAPIDWGEEYSNSGGGGSPSPSTPESATLSEKRRRAKQVVSVVQDEEVGLPFEASPESPPPASPDGVTEIRGLLAQGLRPESPPPAGPLLNGAPAGESPQPKAAPEASSPPASPLQHLLPGKAVDLGPPKPSDQETGEQVSSPSSHPALHTTTEDSAGVQTEF

SEQ ID NO: 101 - DNA, 1552 bp, Homo sapiens
gtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgcctggctgagaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 102 - protein, 279 aa, Homo sapiens
MTERFDCHHCNESLFGKKYILREESPYCVVCFETLFANTCEECGKPIGCDCKDLSYKDRHWHEACFHCSQCRNSLVDKPFAAKEDQLLCTDCYSNEYSSKCQECKKTIMPGTRKMEYKGSSWHETCFICHRCQQPIGTKSFIPKDNQNFCVPCYEKQHAMQCVQCKKPITTGGVTYREQPWHKECFVCTACRKQLSGQRFTARDDFAYCLNCFCDLYAKKCAGCTNPISGLGGTKYISFEERQWHNDCFNCKKCSLSLVGRGFLTERDDILCPDCGKDI

SEQ ID NO: 103 - DNA, 1735 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 104 - protein, 279 aa, Homo sapiens; identical to SEQ ID NO: 102

SEQ ID NO: 105 - DNA, 1907 bp, Homo sapiens
agggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactgtggctgagaactgtgtcttcctggagactaggctggcattttgactttgggacggagtctcgctttgtcgcccaggctggagtgcagtggcacgatctcagctcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 106 - protein, 279 aa, Homo sapiens; identical to SEQ ID NO: 102

SEQ ID NO: 107 - DNA, 1727 bp, Homo sapiens
aaagtgaggtccctttctggtgctggtggccttcccagtttagccaccctttggattcctggaaaatatgaggcctcgtgtgtccttgaagcaggcaggacaaacgaggacatggcagccccttcccatctgggagctgaggcttctttaatctggagaccttaaaaggcacgtgggagccaggggctgggttcttatctcctaggcctggccaatgtccagacgtgccttatttatagcgccactgacaagggcagcgcagctggctggcagctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaaaaaaaaaaaaaaaaaaa

SEQ ID NO: 108 - protein, 279 aa, Homo sapiens; identical to SEQ ID NO: 102

SEQ ID NO: 109 - DNA, 607 bp, Homo sapiens
atgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacagggcggctggggcggccgggcagaggcgcccctcacctcccggacagggcggctgggcggctggccgggcagaggggctcctcacttcccagtaggggcggctgggcagaggggctcctcacttcccagtaggggcggccgggcagaggcgcccctcacctcccggacggggcggctggccgggcggggggctga

SEQ ID NO: 110 - DNA, 4127 bp, Homo sapiens
gtgctccgctggttgaaagcggatccgggctggaggcggtgtcacggtgtatgaatattgattacgcgtcgcagcgcccagggcccagcgcccagcctccagtgcccgcccctctcggccgcccgacgctctctgctcgcgcttgggctcgcgatggggaagaagtcccgggcggtacccggccgtaggcccatcctgcaactctctccgccgggtcctcggggcagcacgccgggccgggacccggagccggaacccgacactgagccggactcaaccgcggcggtccccagccagcccgccccgtcggcggcgacgaccaccaccaccgcggtgactgccgccgcggcctcggacgactcgccttcagaagatgaacaggaagcggtgcaggaggttcctagagttgttcagaatcctccaaaaccagtcatgaccactagacccacagctgttaaagcaacaggcggtctatgcttgcttggtgcttatgctgacagtgatgacgatgacaatgatgtttccgaaaaactagcacaatccaaagagacaaatggaaaccagtcaactgatattgatagtacattggccaacttcctagcggagatcgatgccataacagctcctcagcctgcagctcctgtaggagcttctgctccacctccaactccacctcgaccagagccaaaggaagcagcaacatctaccctttcttcttctacttcaaatggaacagactccacccaaacatctggttggcaatatgatactcagtgttcactggcaggagtcggaattgagatgggcgattggcaggaagtctgggatgagaacacgggatgttattattattggaatacacaaacaaatgaagtgacttgggagttaccccaatatcttgccacacaggtacagggattacagcattaccagcccagttctgtgccaggtgctgaaactagttttgtggtaaatacagacatatattctaaggagaaaacgatttctgtttccagtagtaaaagtggaccagtcatagccaagcgagaagttaaaaaggaagtaaatgaaggaattcaggctctctcaaatagtgaggaggagaagaaaggggtggcagcatcgctgcttgctcctttattgcctgagggaataaaagaagaagaagagagatggagaagaaaagtaatttgtaaagaggagccagtttcagaagtaaaagaaacaagtacaacagtagaagaagcaacaacaatagtaaagccacaggaaattatgttggacaatatagaagacccttctcaggaggatctttgcagtgttgtccaatctggagaaagtgaggaggaagaggaacaagatacccttgaactggagctagttttggaaaggaaaaaagcagagttgcgagccttggaggaaggagatggtagtgtgtcagggtctagtccacgttctgatatcagccagccagcatctcaagatggaatgcgtaggcttatgtctaaaagaggaaaatggaagatgtttgttcgagctaccagtccagaatctaccagtaggagttctagtaaaactggacgagatactccagaaaatggagaaactgcaattggtgctgaaaattcagaaaaaatagatgagaattcagataaagagatggaagtagaagaatctccagagaaaataaaagtacagacaacaccaaaagtagaagaagaacaggatttgaaatttcagattggagaactggcaaataccctgacaagtaaattcgagtttctaggcattaatagacaatccatctccaactttcatgtgctgctcttacagactgagactcgaattgcagactggcgggaaggggctcttaatggaaactaccttaaacgaaaacttcaggatgcagcagaacaactaaaacagtatgaaataaacgccactcctaaaggctggtcctgccactgggacagggatcatagacggtatttctatgtaaacgaacagtcgggcgagtctcagtgggagtttccagatggtgaagaggaagaagaagaaagccaagcacaagaaaatagagatgagactcttgccaaacagaccttgaaagacaaaactggcactgattcaaattcaacagaatcctctgaaacttccacaggttctctttgtaaagaatccttttctggtcaagtttcttcttcatcactcatgccacttactccattctggaccctccttcagtcaaatgttcctgtgcttcaacctccattacccttggaaatgccaccacccccacctccacctccagaatcacctccaccccctcctccaccacctcctcctgcggaagatggtgagatccaggaggtagagatggaggatgagggaagtgaggagccccctgccccaggaacagaggaagatacccctttgaaaccttcagcacaaaccacagttgtaactagccagagttcagttgattccaccatctctagttcttcttccactaaaggaataaagaggaaagctacagaaattagcactgcagtggttcagaggtcagctaccattggcagttctccagttctctatagccagtcagctatagctacaggtcaccaggcagcagggattggaaaccaggcaacaggaattggacatcagacaataccagttagccttccagcagcaggaatgggtcatcaggccagaggaatgagcctgcagtcaaattaccttggactagcggcagcacctgcaattatgagttatgcagaatgttctgtcccaattggagtgactgctccctcattgcagccagttcaggcccgaggtgctgtgcctaccgctaccattatagaaccaccaccaccacctcctcctcctcctcctccaccaccaccagctcccaaaatgccaccacctgaaaagacaaaaaaaggaaggaaagacaaggcaaagaagagtaagaccaaaatgccatctttggtaaaaaagtggcagagtatccagcgtgagttagatgaagaggacaattctagttccagtgaagaggatcgggaatcaactgcacagaagcgaattgaagagtggaaacagcagcagctggttagtggcatggcagagagaaatgctaattttgaagcccttcctgaggattggagagcaaggctgaagagaaggaaaatggctccaaacacatagtttttaagtttttaaaacttttttgtattattgtttgttttgtgttcagttcaaagtcttaaccagttttattgtcaaataaactataaatgttatgggggagatcttataaatttcctgggcaagagtgtatgcatacaaagttttcacttttgtgaaatgtaatttttctgtttttgcaaagggatgaggtgattggaattgctttgaccatgctgcctttattctcaaactggcaaacttagcatgttaggtgtattaacctcatcagtcttgaagaacatgtggctcatgagtataacacttctgtagaggactccctgacaaaagtgaagaattaacttctcctccagaacaagtgcaattcagaaggcagctctgcattctaccttgcttgactggaattgtctgaagctttttctggcctcttttctctagtcggccacccctgaagtgctgaggtctaagtggtttacctcgtgctgatagatggccacactctttagagtagttctcataagttctagaactggtagctcggtcgtttcgcacactaggtggcatacaggcagcagcaggtgttcatatccttgattttgagaatttcccctcaagtatgtggcagtaaatacaacaagacactctatgtattaatgtctccattgtcttaaccctgttccaaaacaaaattcacctcctttctttatgtgaatgtattctccataaaattccagtatttaaaaagcagtttactgttctgtactttctgttgtatcacaatcaggtaaaagtcactttaaactgaggaaacggcaaattgtgttttaaagctctttgtatttctccagtttctgaccttgtaaatttgtatatatgcactaataaagctttttttataatcctgaaaaaaaaaaaaaaaa

SEQ ID NO: 111 - protein, 1017 aa, Homo sapiens
MGKKSRAVPGRRPILQLSPPGPRGSTPGRDPEPEPDTEPDSTAAVPSQPAPSAATTTTTAVTAAAASDDSPSEDEQEAVQEVPRVVQNPPKPVMTTRPTAVKATGGLCLLGAYADSDDDDNDVSEKLAQSKETNGNQSTDIDSTLANFLAEIDAITAPQPAAPVGASAPPPTPPRPEPKEAATSTLSSSTSNGTDSTQTSGWQYDTQCSLAGVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 112 - DNA, 1245 bp, Homo sapiens
ataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatgtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagttctaatcacactaatcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcattaaaggctgaaaaaaaaaaaaaaaaaa

SEQ ID NO: 113 - protein, 183 aa, Homo sapiens
MTTASTSQVRQNYHQDSEAAINRQINLELYASYVYLSMSYYFDRDDVALKNFAKYFLHQSHEEREHAEKLMKLQNQRGGRIFLQDIKKPDCDDWESGLNAMECALHLEKNVNQSLLELHKLATDKNDPHLCDFIETHYLNEQVKAIKELGDHVTNLRKMGAPESGLAEYLFDKHTLGDSDNES

SEQ ID NO: 114 - DNA, 6329 bp, Homo sapiens
gattgggggcggtggtctgggtgtgattcctgtgggggaaaccagcccgaggtgccttggctcaggcttgcctgcctggagtccttgtcgtgtacccgtctgtggccctagagtcacctcctgctccttttcactgggtttctccccagaccaagcccctggatttgagcttctgagcagccaactgatttttttcatgagggaaagaattttgctcctagatttatttctaatccttttctccgtaactgaccttttctctgtaagctatttgtggctctagtgggtttttgtttgcttgcttgtttttgttttatctttgccctgaacgtccatcctggcctcggctgcctccctccccgagttcttcactacacctcctgtctcagcctcccagagagggtggcgagggtgctgatgcccagagacaccatccggcgaatggacctctcctgtcatgcggggcagggcagggctgccggcagagccatgtcctgaaccctccctcctcccccctgctctccttaagggtctttcccagatgtgaaggtccctcccaggctctactgaggtcagaccaattcccagtggcttgggtaccctcgttcactccagcaccagcccctgccctccttcttcccgggccaggctgccaggtgagccccgggccaagggtggttgccctgctgaggccgaaaggactcgagcttcccatctcctcgcctcccccaggtctttcaccgtctggactcatctctgggtaactcatggtgtgagtggccacgtggctggctcaggtgagtccttttagaccccaggtgacccaccagctagtccggggcccattgttgtgcccactaggatgtcccccatggtgtcctccctgcgctttaaagttctccttcgtgtgctgttcttcatggcccctgttcccccacaggtgtttggacagtgaacgccaggtcccctcctccccacccccggcctctcaaacacgcccagccccacgatggcagcagagacactcaactttgggcctgagtggctcagggccctgtccgggggcggcagcgtggcctccccacccccgtcccctgccatgcccaaatacaagctggctgactaccgttatgggcgagaggaaatgctggctctctacgtcaaggagaacaaggtcccggaagagctgcaggacaaggagttcgccgcggtgctgcaggacgagccactgcagcccctggctctggagccgctgactgaggaggaacagagaaacttctccctgtcagtgaacagcgtggctgtgctgaggctgatggggaaaggggctggcccccccctggctggcacctcccgaggcaggggcagcacgcggagccgaggccgcggccgtggtgacagctgcttttaccaaagaagcatcgaagaaggcgatggggcctttggacgaagcccccgggaaatccagcgcagccagagctgggatgacagaggcgagaggcggtttgagaagtcagcaaggcgggatggagcacgatgtggctttgaggagggaggggctggcccaaggaaggagcacgcccgctcagacagcgagaactggcgctccctacgggaggaacaggaggaggaggaggagggcagctggaggctcggagcagggccccggcgagacggcgaccgctggcgctccgccagccctgatggtggtccccgctctgctggctggcgggaacatggggaacggcggcgcaagtttgaatttgatttgcgaggggatcgaggagggtgtggtgaagaggaggggcggggagggggaggcagctctcacctgcggcggtgccgagcgcctgaaggctttgaggaggacaaggatgggctcccagagtggtgcctggacgatgaggatgaagaaatgggcacctttgatgcctctggggccttcttgcctctcaagaagggccccaaggagcccattcctgaggagcaggagctggacttccaagggttggaggaggaggaggaaccttccgaagggctagaggaggaagggcctgaggcaggtgggaaagagctgaccccactgcctcctcaggaggagaagtccagctccccatccccactgcccaccctgggcccactctgggggacaaacggggatggggacgaaactgcagagaaagagcccccagcggccgaagatgatattcgggggatccagctgagtcccggggtgggctcctctgctggcccacccggagatctggaggatgatgaaggcttgaagcacctgcagcaggaggcggagaagctggtggcctccctgcaggacagctccttggaggaggagcagttcacggctgccatgcagacccagggcctgcgccactctgcagccgccactgccctcccgctcagccatggggctgcccggaagtggttctacaaggacccacagggcgagatccaaggccccttcacgacacaggagatggcagagtggttccaggccggctacttttccatgtcactgctggtgaagcggggctgcgatgagggcttccagccgctgggcgaggtgatcaagatgtggggccgcgtgccctttgccccagggccctcacctcccccactgctgggaaacatggaccaggagcggctgaagaagcaacaggagctggccgcggcggccttgtaccagcagctgcagcaccagcagtttctccagctggtcagcagccgccagctcccacagtgcgcgctccgagaaaaggcagctctgggggacctgacaccgccaccaccgccgccgccacagcagcagcagcagcagctcacggcattcctgcagcagctccaggcgctcaaaccccccagaggcggggaccagaacctgctcccgacgatgagccggtccttgtcggtgccagattcgggccgcctctgggacgtacatacctcagcctcatcacagtcaggtggtgaggccagtctttgggacataccaattaactcttcgactcagggtccaattctagaacaactccagctgcaacataaattccaggagcgcagagaagtggagctcagggcgaagcgggaggaagaggaacgcaagcgtcgagaggagaagcgccgccagcagcagcaggaggagcagaagcggcggcaggaggaggaagagctgtttcggcgcaagcacgtgcggcagcaggagctattgctgaagttgctacagcagcagcaggcggtccctgtgccccccgcacccagctccccgcccccactctgggctggcctggccaagcaggggctgtccatgaagacgctcctggagttgcagctggagggcgagcggcagctgcacaaacagcccccacctcgggagccagctcgggcccaggcccccaaccaccgagtgcagcttgggggcctgggcactgcccccctgaaccagtgggtgtctgaggctgggccactgtggggcgggccagacaagagtgggggcggcagcagcggcctggggctctgggaggacacccccaagagcggcgggagcctggtccgtggcctcggcctgaagaacagccggagcagcccatctctcagtgactcatacagccacctatcgggtcggcccattcgcaaaaagacggaggaagaagagaagctgctgaagctgctgcagggcattcccaggccccaggacggcttcacccagtggtgcgagcagatgctgcacacgctgagcgccacgggcagcctggacgtgcccatggctgtagcgatcctcaaggaggtggaatccccctatgatgtccacgattatatccgttcctgcctgggggacacgctggaagccaaagaatttgccaaacaattcctggagcggagggccaagcagaaagccagccagcagcggcagcagcagcaggaggcatggctgagcagcgcctcgctgcagacggccttccaggccaaccacagcaccaaactcggccccggggagggcagcaaggccaagaggcgggcactgatgctgcactcagaccccagcatcctggggtactccctgcacggatcttctggtgagatcgagagcgtggatgactactgaccagcccggacccccagcccctgggctgtaggccagggcagccacagcggcgtggaccgagggtcccagcctgcaggctccccgcagagagcacaggaagaggcaggggcggggtccccagcacttgttacaaacacacgatgcaccttaactcacccaccacgaggcactttacagactgggggagggggtttttctttttatttttttttttaattttaaacgactgaagaaaacattaggagaggcaaaaatattgttaaaaactagactctaaacaccccttcctgctgtgaggatagtgggtgtgacaatggaaggtccacagaggtttttgttttttggttttttttttttttttaagaaaaaaagatgaaaaatgaaaaaaaaaatggttaggaggctgaaagaaaaaacacactgttattttggggcagtggggacacaggccccgtggacctgtcctgcctggcccccaaggccatacttaccccccagaaggcgggccatggggtaactggaagctgggggccagcagtttgcacaggaggcctgtctgagccccacccgccagacctgttgtgagcagctcctgtcactgaggctggctgaggtgtccggggtggggccaaagtagccccttggcttcgctgctttgggggacagttgcacaaattggacgagtggccccagctctctggctgccatcttgtgctggccgagtagacgggaggggccaagccgtgccaacctctctggctggcagggtggggcagcaggactctggttctggtgaggggcgtctcccactgctgccattttgggggacaccctgggtttgaacctgaaagccccagctctctgccttgccacgtgaatgtattctttgggccacaagcccccgcctcacccctgcctgagctgcctcacccctgtgagcggcgggggtggatgattgctccagaggctgcagagagaaggctgagctgtttctccagtgaagggggcaggaggaggggcctcaaaggcaaggagtgggtggctttgggcttagggttgcagtagaggggctgccgcccggggccccaacctgtagccagctcgtaagatgtggaccacccagctctgcacctgacccttccgctgaccaaatgggagaggagcaggtggccttccgggtctgatatgatgcgctttttaccgttgggtaaggttggggtgaagagaagtgtgcggctcctgggtcagaggaggctgccccttctattgctcacccacttcttattcccggtcccctacttgggttcgtctccgcccattttgggttttgtaacagttttgtcttttgggtttctcatccagctcctcccattgacctcattgctcagagtgcagtattagggcaaggcttcgccactgcctccctccatgaatgtatttctccctcctgccctggggacatggggagtggcccgtttctttccccatctagtcccagaaagatggtgtttggttttctgttgttggatttttttttttttttttttttttttgcaccaaagtggcaactaggtcagtgttgggggatcaagctggcctcggggtggggggcccccacctgcctctccctggttcccacagtgttagcgtccctgaaaagacaatattctctctaaagcaataaggggtgacgggccggggggagtgtttgctgctgctggcccccagctccccttccctcttgccaggtgtgggggagactcctgttgtgactgaatgtaacccccccacccctgccgcagccaatgcaggggaagggggacactcttcctgtctcttctccccagctaaagagactttggacttagggggcccatgagcctggagaggccttaaccctgtgaggaagtatagggggagccctctcccacccccatccccttctgagagtggtcaatgtttacaagcccctgagcccccctgcccagggactcagaccctgttgctgtccttccccggccccggtcttcctgggccctcgctgctcccctgcccttcctggggttggggtgggtgcaggggtcaccgtgttccctgtctgccttgtacccacagtctccccgccccctctccaccctgtgtgacttccctctcttttacctgctcctgtaaatactcccttctcccaataaaacttggtgtgtgttctccc

SEQ ID NO: 115 - protein, 1035 aa, Homo sapiens
MAAETLNFGPEWLRALSGGGSVASPPPSPAMPKYKLADYRYGREEMLALYVKENKVPEELQDKEFAAVLQDEPLQPLALEPLTEEEQRNFSLSVNSVAVLRLMGKGAGPPLAGTSRGRGSTRSRGRGRGDSCFYQRSIEEGDGAFGRSPREIQRSQSWDDRGERRFEKSARRDGARCGFEEGGAGPRKEHARSDSENWRSLREEQEEEEEGSWRLGAGPRRDGDRWRSASPDGGPRSAGWREHGERRRKFEFDLRGDRGGCGEEEGRGGGGSSHLRRCRAPEGFEEDKDGLPEWCLDDEDEEMGTFDASGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDEGFQPLGEVIKMWGRVPFAPGPSPPPLLGNMDQERLKKQQELAAAALYQQLQHQQFLQLVSSRQLPQCALREKAALGDLTPPPPPPPQQQQQQLTAFLQQLQALKPPRGGDQNLLPTMSRSLSVPDSGRLWDVHTSASSQSGGEASLWDIPINSSTQGPILEQLQLQHKFQERREVELRAKREEEERKRREEKRRQQQQEEQKRRQEEEELFRRKHVRQQELLLKLLQQQQAVPVPPAPSSPPPLWAGLAKQGLSMKTLLELQLEGERQLHKQPPPREPARAQAPNHRVQLGGLGTAPLNQWVSEAGPLWGGPDKSGGGSSGLGLWEDTPKSGGSLVRGLGLKNSRSSPSLSDSYSHLSGRPIRKKTEEEEKLLKLLQGIPRPQDGFTQWCEQMLHTLSATGSLDVPMAVAILKEVESPYDVHDYIRSCLGDTLEAKEFAKQFLERRAKQKASQQRQQQQEAWLSSASLQTAFQANHSTKLGPGEGSKAKRRALMLHSDPSILGYSLHGSSGEIESVDDY

SEQ ID NO: 116 - DNA, 1083 bp, Homo sapiens
atggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaa

SEQ ID NO: 117 - protein, 360 aa, Homo sapiens
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 118 - DNA, 4507 bp, Homo sapiens
ttccggccagcccctcccccgcctccctcgcgtggccacctccccctctgccttctcctacccagtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatgttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatatttaaactttcaaaaaaaaaaaaaaa

SEQ ID NO: 119 - protein, 1049 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMLADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 120 - DNA, 4531 bp, Homo sapiens
ttccggccagcccctcccccgcctccctcgcgtggccacctccccctctgccttctcctacccagtctcttccccaactctccccacccctggtgctctccgccccgcttgcctcccgttcttccccgcccgctccatccgggtcgctgacggctgtctctggactggacagcagtggcgtccgcttttctctaaggaacccgataagaactccattttctgttgatgtggagacatagggtacctccaactttccggggtttcagaagagaattttttattgaaactggaagaccaaaataattacaagcatgttgtgctggggaaatgcatcctttgggcagctaggtttgggtggaattgatgaagaaattgtactagagcccagaaaaagtgacttctttataaataaaagggtccgagatgtaggatgtggactcagacatactgtgtttgttctggatgatggaacagtgtacacatgtggatgtaatgatctaggacagctaggtcatgaaaaatccagaaagaaaccagagcaggttgttgccctggatgcccaaaatattgtagctgtttcatgtggagaagctcatacgttagcgctaaatgacaaaggccaggtgtatgcttggggtctcgattctgatggacagcttggcctggtaggatcagaggaatgcatcagagtacccagaaatattaaaagtttgtcagatatccagattgtacaggttgcttgtggttactatcattcacttgcactttctaaagcaagtgaagtcttctgttggggacagaataaatatggccaattgggtttaggtactgactgtaaaaagcaaacttcaccgcagctgcttaagtctttgcttggaatccctttcatgcaagttgcagcaggaggagcccatagttttgtactcaccctttctggagctatctttggatggggacgcaacaagtttggtcagctaggtcttaatgatgaaaatgataggtatgttcctaatttactaaagtcactaagatctcagaaaatagtttatatttgttgtggagaagatcatactgctgctctaaccaaggaaggtggagtgtttacttttggagctggagggtatggtcagttgggccataattctaccagtcatgaaataaacccaaggaaagtttttgaacttatgggaagcattgtcactgagattgcttgtggacggcagcacacttctgcttttgttccttcatcaggacgaatttactcttttgggcttggtggtaatgggcagctgggaaccggttcaacaagcaacaggaaaagcccctttactgtaaaaggaaattggtacccctataatgggcagtgtctaccagatattgattctgaagaatatttctgtgtaaaaagaattttctcagggggagatcaaagcttttcacattactctagtccccagaactgtgggccaccagatgacttcagatgtcccaatccgacaaagcagatctggacagtgaatgaagctctaattcagaaatggctgagctatccttctggaaggtttcctgtggagatagccaatgagatagatggaacgttttcttcctctggttgcctaaatggaagttttttagctgttagcaatgatgatcactatagaacaggtaccagattttcaggggttgatatgaatgctgctaggcttttattccacaaacttatacaacctgatcatccgcagatatctcagcaggtggcagctagtttggaaaagaatcttattcctaaactgactagctccttacctgatgttgaagcattgaggttttatcttactctaccagaatgtcccctgatgagtgattccaacaatttcacaacaatagcaattccctttggtacagctcttgtgaacctagaaaaggcaccactgaaagtacttgaaaactggtggtcagtacttgaacctccactattcctcaagatagtagaactttttaaggaagttgtggtacatcttttgaaactctacaagatcggtattcccccttctgaaagaagaattttcaacagttttcttcatactgcattaaaggttttagaaatactacatagggtaaatgagaaaatgggacagattatacagtatgataaattttatatacatgaagtacaagaattgatagacataagaaatgattatatcaactgggtccaacagcaggcctatggaatggatgtcaaccatggattaactgagttggcagatatccctgttacaatctgtacatatccatttgtatttgatgcccaagcaaaaactactctgttacagaccgatgcagtcttacagatgcagatggctattgatcaggcccacaggcagaatgtctcctctctttttctcccagtgattgaatctgtgaatccctgcttaattctagtggtgcgtagagaaaatattgtaggagatgcaatggaagtccttaggaaaacaaagaacatagattacaagaagccactcaaggttatatttgttggagaagatgctgtggatgcaggaggggtgcgcaaagaatttttcttgctcatcatgagggaattattggatcctaaatacggcatgtttaggtattatgaagattccaggctcatttggttttctgataagacatttgaagacagtgatttgttccatttgattggtgttatctgtggcttagcaatttataattgtaccattgtggacctccattttcctttggctttatataagaaactactgaaaaagaagccatccttggatgatttgaaagaactaatgcctgatgttgggagaagcatgcaacagttactggattatccagaagatgacatagaggaaacattttgtcttaattttacgatcacagttgaaaactttggtgcaacagaagtgaaagagctggttctaaatggtgcagacacagctgttaacaaacaaaatcggcaagagtttgtcgatgcttatgtggattacatattcaataaatcagtggcttccttatttgatgcttttcatgcgggctttcataaggtctgtggaggaaaagtccttctgctctttcagcctaatgaactacaagcaatggtcattggaaatacaaattatgattggaaggaactggaaaagaatacagaatacaaaggggaatattgggcagaacatcctacgataaaaattttttgggaagtatttcacgaattaccattggaaaagaagaaacagtttctgttatttttgacaggtagtgatcgcattcctattcttggtatgaagagtctgaaactagtcatccagtccacaggaggtggtgaggagtatctcccagtttcccatacttgttttaatcttctggatcttccaaaatatacagaaaaagaaactctacgctctaaactgatccaagctattgatcacaatgaaggcttcagtttaatataactttggagttataactattcagtttagtgcaaaagcattaaactatttgtgtttttcttgtggtgatgaattcagcaaggtgacagaggtactattataattcttacttgcagaatgttcaatctacgagtgttcatggaagccaaaaaatattaaaggaaaatgaacaaactgttaatattattgtacagaaccatggattttttttgaccatcttctaataaacatagcaagtattatgaatacattaaagttttactaacatgaattttaagagtttgcatatttcagaaatgatctggtgtgagtgcatggaaatattgcttaatttttcttcaatcattgagtgaaaaacctttaactttggcctgcaatagtcatttgattattttttcattttgtaaataatgttaagttttgtaataaaatagttatgttctgataccagtacagtttctatggttgtaattgaacttgaacagacttttaaaggttaaaaattatgatttaaatcttactctgagactctataaaaagaaaaaaaaggtagcatggtggaaacactatcttttcttttttgctagaataagtgtctttgtgcaaacctaaatcacagatagggaatatactacataacctgcagttcttttctttgtgaatcctgacacactgatagatgggggattgtcgatcagagaacttattaatatttagtactggaagaactctgtctccacagttgccagtaataaaaagaaacattggctactatgagcaccaatcactgggttatagctttcaaaattattgatgctgcagtgctttagagctatttccttgaatttaagaaacaaatcttaacagttttatggtgctgatgcttagttgtctcatgccattaaattgtaaaagtgagttgatgcaatacatgtgactttctgctataatgcaaatatttattttttaaatttattttaaaatgccgtgaaaactgtttaataaagatttattgttttaatatttaaactttcaaaaaaaaaaaaaaa

SEQ ID NO: 121 - protein, 1057 aa, Homo sapiens
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 122 - DNA, 3719 bp, Homo sapiens
atttagtccgcaacacctcgctccccaggaggtctgccagcctggactggaagcgtgcaacactccagagtcgtaggagtgaacactgcacaggaatctctgcccatctcaggagaaaccaaacttggggaaaatgtttgcggtccacttgatggcattttacttcagcaagctgaaggaggaccagatcaagaaggtggacaggttcctgtatcacatgcggctctccgatgacacccttttggacatcatgaggcggttccgggctgagatggagaagggcctggcaaaggacaccaaccccacggctgcagtgaagatgttgcccaccttcgtcagggccattcccgatggttccgaaaatggggagttcctttccctggatctcggagggtccaagttccgagtgctgaaggtgcaagtcgctgaagaggggaagcgacacgtgcagatggagagtcagttctacccaacgcccaatgaaatcatccgcgggaacggcacagagctgtttgaatatgtagctgactgtctggcagatttcatgaagaccaaagatttaaagcataagaaattgccccttggcctaactttttctttcccctgtcgacagactaaactggaagagggtgtcctactttcgtggacaaaaaagtttaaggcacgaggagttcaggacacggatgtggtgagccgtctgaccaaagccatgagaagacacaaggacatggacgtggacatcctggccctggtcaatgacaccgtggggaccatgatgacctgtgcctatgacgacccctactgcgaagttggtgtcatcatcggaactggcaccaatgcgtgttacatggaggacatgagcaacattgacctggtggagggcgacgagggcaggatgtgcatcaacacagagtggggggccttcggggacgacggggccctggaggacattcgcactgagttcgacagggagctggacctcggctctctcaacccaggaaagcaactgttcgagaagatgatcagtggcctgtacctgggggagcttgtcaggcttatcttgctgaagatggccaaggctggcctcctgtttggtggtgagaaatcttctgctctccacactaagggcaagatcgaaacacggcacgtggctgccatggagaagtataaagaaggccttgctaatacaagagagatcctggtggacctgggtctggaaccgtctgaggctgactgcattgccgtccagcatgtctgtaccatcgtctccttccgctcggccaatctctgtgcagcagctctggcggccatcctgacacgcctccgggagaacaagaaggtggaacggctccggaccacagtgggcatggacggcaccctctacaagatacaccctcagtacccaaaacgcctgcacaaggtggtgaggaaactggtcccaagctgtgatgtccgcttcctcctgtcagagagtggcagcaccaagggggccgccatggtgaccgcggtggcctcccgcgtgcaggcccagcggaagcagatcgacagggtgctggctttgttccagctgacccgagagcagctcgtggacgtgcaggccaagatgcgggctgagctggagtatgggctgaagaagaagagccacgggctggccacggtcaggatgctgcccacctacgtctgcgggctgccggacggcacagagaaaggaaagtttctcgccctggatcttgggggaaccaacttccgggtcctcctggtgaagatcagaagtggacggaggtcagtgcgaatgtacaacaagatcttcgccatccccctggagatcatgcagggcactggtgaggagctctttgatcacattgtgcagtgcatcgccgacttcctggactacatgggcctcaagggagcctccctacctttgggcttcacattctcatttccctgcaggcagatgagcattgacaagggaacactcatagggtggaccaaaggtttcaaggccactgactgtgaaggggaggacgtggtggacatgctcagggaagccatcaagaggagaaacgagtttgacctggacattgttgcagtcgtgaatgatacagtggggaccatgatgacctgtggctatgaagatcctaattgtgagattggcctgattgcaggaacaggcagcaacatgtgctacatggaggacatgaggaacatcgagatggtggaggggggtgaagggaagatgtgcatcaatacagagtggggaggatttggagacaatggctgcatagatgacatccggacccgatacgacacggaggtggatgaggggtccttgaatcctggcaagcagagatacgagaaaatgaccagtgggatgtacttgggggagattgtgcggcagatcctgatcgacctgaccaagcagggtctcctcttccgagggcagatttcagagcgtctccggaccaggggcatcttcgaaaccaagttcctgtcccagatcgaaagcgatcggctggcccttctccaggtcaggaggattctgcagcagctgggcctggacagcacgtgtgaggacagcatcgtggtgaaggaggtgtgcggagccgtgtcccggcgggcggcccagctctgcggtgctggcctggccgctatagtggaaaaaaggagagaagaccaggggctagagcacctgaggatcactgtgggtgtggacggcaccctgtacaagctgcaccctcacttttctagaatattgcaggaaactgtgaaggaactagcccctcgatgtgatgtgacattcatgctgtcagaagatggcagtggaaaaggggcagcactgatcactgctgtggccaagaggttacagcaggcacagaaggagaactaggaacccctgggattggacctgatgcatcttggatactgaacagcttttcctctggcagatcagttggtcagagaccaatgggcaccctcctggctgacctcaccttctggatggccgaaagagaaccccaggttctcgggtactcttagtatcttgtactggatttgcagtgacattacatgacatctctatttggtatatttgggccaaaatgggccaacttatgaaatcaaagtgtctgtcctgagagatcccctttcaacacattgttcaggtgaggcttgagctgtcaattctctatggctttcagtcttgtggctgcgggacttggaaatatatagaatctgcccatgtggctggcaggctgtttccccattgggatgcttaagccatctcttataggggattggaccctgtacttgtggatgaacattggagagcaagaggaactcacgttatgaactagggggatctcatctaacttgtccttaacttgccatgttgacttcaaacctgttaagagaacaaagactttgaagtatccagccccagggtgcagagaggttgattgccagggagcactgcaggaatcattgcatgcttaaagcgagttatgtcagcaccctgtaggattttgttccttattaagtgtgtgccatgtggtggggtgctgtctggggcatctgtttttcattttgcctgtggtttgtgttgcaggtgttgatagttgttttaaggattgttaggtataggaaatccagtaaattaataaaaaaattttgattttccaataaactttgcaaaaaaaaaaaaaaaaaaaaaaaaaaaaaaa

SEQ ID NO: 123 - protein, 917 aa, Homo sapiens
MFAVHLMAFYFSKLKEDQIKKVDRFLYHMRLSDDTLLDIMRRFRAEMEKGLAKDTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIRTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 124 - DNA, 2339 bp, Homo sapiens
acgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaaaaaaaaaaaaaaaaaaaa

SEQ ID NO: 125 - protein, 573 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 126 - DNA, 2319 bp, Homo sapiens
gccccgacgcgcaccgcgattcgccccaagggccctgcgcaggacgctgacgcgaagactcggaggcggaagaaaaaaggagctgtttctaggcttttctaggcgcccagccgagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaaaaaaaaaaaaaaaaaaaa

SEQ ID NO: 127 - protein, 573 aa, Homo sapiens; identical to SEQ ID NO: 125

SEQ ID NO: 128 - DNA, 2232 bp, Homo sapiens
ggcccgggggcggagcaaggcaaggaagcggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggtcttttttaaaaaaaaaaaaaaa

SEQ ID NO: 129 - protein, 648 aa, Homo sapiens
MEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVANKVKAALKSLIPTLEKTKSTSKGIEILLEKLST

SEQ ID NO: 130 - DNA, 3860 bp, Homo sapiens
agagctgccagggattggccagaacttggctttgagtcacaaagctgctgcggcaccagggctccaagactggccgttcagactgctaggtttagcttcaggggcagcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcctggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccgggggctggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaagtgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgatgaccaccaccccacccaagactagcccagttcccaaagtaacaataatcaagaccccagcccagatgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcctgccccaggtatgcccggggcctgcgatggcaaagaccccaccccagatgcacccggtcaccaccccagccaaaaacccattgcaaacatgtctgtcagccacaatgtccaagacttcatcccagaggagcccagttggggtgaccaagccctcaccccagacccgcctgccagccatgataaccaagaccccagcccagttacgctcggtggccaccatcctcaagactctgtgtctggcctctccaacagtggcaaatgtcaaggctccaccccaagtggcggtagcagccggaactcccaacacctcaggctccatccatgagaacccacccaaggccaaggccaccgtgaatgtgaagcaggctgcaaaggtggtgaaagcctcatccccctcctatttggctgaggggaagatcaggtgcctggctcaaccacatccgggaactggggtccccagggctgcagctgagcttcctttggaagccgagaaaatcaagactggcacccagaaacaggcgaaaacagacatggcatttaagaccagtgtggcagtggaaatggctggggctccatcctggacaaaagttgctgaggaaggggacaagccacctcacgtgtatgtgcctgtagacatggctgtcaccctgccccggggacagctggctgccccactgaccaatgcctcatcccagagacatccaccctgcctgtcccagagaccactggccgccccgctgaccaaggcctcatctcagggacatctgcccactgagctgaccaagaccccatccctggcccatctggacacctgtctgagcaagatgcattcccagacacatctggccacaggtgccgtgaaggtccagtcccaagcgcctctagccacctgtctgaccaagacgcagtcccgggggcagccgatcacagacataaccacgtgcctcatcccagcgcaccaggctgctgatctcagcagcaacacccactcccaggtgctcctaacagggtccaaggtgtccaaccacgcctgccagcgcctcggtggcctcagcgccccaccctgggccaagccagaggacagacagacccagccacagccccacggacacgtgccggggaagaccactcaggggggaccatgcccggcagcctgtgaggtccagggtatgctggtgccgccgatggcacccaccggccattccacatgcaacgttgagtcctggggagacaacggagccacacgtgcccagccatcaatgcccggccaggcggtgccctgccaggaggacacgggccccgcggacgctggtgtggttggtggccaatcgtggaaccgcgcatgggagccagccaggggtgctgcgtcctgggacacctggcgcaacaaggcggtggtgcctcccaggcggtccggggagccaatggtgtccatgcaggctgcagaggagatccgcatcctcgcagtgatcactatccaggcgggcgtccgtggctacctggcgcgtcgcaggatccggctgtggcaccggggggccatggtcatccaagctacttggcgcggctaccgtgtgcggcggaacctggcacacctctgcagagccaccacgaccatccagtctgcctggcgcggctacagcacccgccgggaccaagcccggcactggcagatgctccaccccgtcacgtgggtggagctgggcagccgggccggggtcatgtctgaccgaagctggttccaggatggcagagccaggacagtatctgaccatcgctgcttccagtcctgccaggcacacgcttgcagcgtctgccactccctgagctccaggatcgggagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcgaggccaccatacccggagctgtctgaagaacacagaggcgctcttgggaccagcagacccctcggccagctcacggcacatgcattggcctggcatctaggaccctggctccctgcagtggggacttcgtgggaggcactcatggctctctgggtctaatgaataaagtcctccacagcctagaaaaaaaaaaaaaaaaaa

SEQ ID NO: 131 - protein, 1180 aa, Homo sapiens
MTLQGRADLSGNQGNAAGRLATVHEPVVTQWAVHPPAPAHPSLLDKMEKAPPQPQHEGLKSKEHLPQQPAEGKTASRRVPRLRAVVESQAFKNILVDEMDMMHARAATLIQANWRGYWLRQKLISQMMAAKAIQEAWRRFNKRHILHSSKSLVKKTRAEEGDIPYHAPQQVRFQHPEENRLLSPPIMVNKETQFPSCDNLVLCRPQSSPLLQPPAAQGTPEPCVQGPHAARVRGLAFLPHQTVTIRFPCPVSLDAKCQPCLLTRTIRSTCLVHIEGDSVKTKRVSARTNKARAPETPLSRRYDQAVTRPSRAQTQGPVKAETPKAPFQICPGPMITKTLLQTYPVVSVTLPQTYPASTMTTTPPKTSPVPKVTIIKTPAQMYPGPTVTKTAPHTCPMPTMTKIQVHPTASRTGTPRQTCPATITAKNRPQVSLLASIMKSLPQVCPGPAMAKTPPQMHPVTTPAKNPLQTCLSATMSKTSSQRSPVGVTKPSPQTRLPAMITKTPAQLRSVATILKTLCLASPTVANVKAPPQVAVAAGTPNTSGSIHENPPKAKATVNVKQAAKVVKASSPSYLAEGKIRCLAQPHPGTGVPRAAAELPLEAEKIKTGTQKQAKTDMAFKTSVAVEMAGAPSWTKVAEEGDKPPHVYVPVDMAVTLPRGQLAAPLTNASSQRHPPCLSQRPLAAPLTKASSQGHLPTELTKTPSLAHLDTCLSKMHSQTHLATGAVKVQSQAPLATCLTKTQSRGQPITDITTCLIPAHQAADLSSNTHSQVLLTGSKVSNHACQRLGGLSAPPWAKPEDRQTQPQPHGHVPGKTTQGGPCPAACEVQGMLVPPMAPTGHSTCNVESWGDNGATRAQPSMPGQAVPCQEDTGPADAGVVGGQSWNRAWEPARGAASWDTWRNKAVVPPRRSGEPMVSMQAAEEIRILAVITIQAGVRGYLARRRIRLWHRGAMVIQATWRGYRVRRNLAHLCRATTTIQSAWRGYSTRRDQARHWQMLHPVTWVELGSRAGVMSDRSWFQDGRARTVSDHRCFQSCQAHACSVCHSLSSRIGSPPSVVMLVGSSPRTCHTCGRTQPTRVVQGMGQGTEGPGAVSWASAYQLAALSPRQPHRQDKAATAIQSAWRGFKIRQQMRQQQMAAKIVQATWRGHHTRSCLKNTEALLGPADPSASSRHMHWPGI

SEQ ID NO: 132 - DNA, 613 bp, Homo sapiens
tctcctttttttccagccccggccccagacgctacagccgccgaaatgttgatgcctaagaagaaccggattgccatttatgaactcctttttaaggagggagccatggtggccaagaaggatgtccacacgcctaagcagccggagttggcagacaagaatgtgcccaaccttcatgtcatgaaggccatgcagtctctgaagtcccgaggctacatgaaggaacagtttgcctggagacatttctactggtaccttaccaatgagggtatccaccatctccgtgattaccttcatctgcccccggagattgtgcctgccaccctatgccacagccgtccagagactggcaggcctgggcctaaaggtctggagggtgagtgacctgcaagactcacaagaggggaagccaacagagatacctacagatggaatgctgtgcttcctggtgctgacaagaaagccgatgctgggagtgggtcagcaaccgaattccagtttagaggcagatttggtcgtggacatggtcagccatctcagtaaaattggagaggattattttgcattgaataaacttacagccaaaaaaaaaaaagtcaaacagaataatatg

SEQ ID NO: 133 - DNA, 1321 bp, Homo sapiens
tcagccgaagtgctgggattacagacctgagccactgcgcccagccttgatcttgaggtttcctgggagaaggtggcttaaggctgagacacttatgccctgggccagccactggattcctgtgctctgcttcactcctagttaccagaaaggtggaatctggatgagtggaggccccagcggaaaggcgcagatacccggagacttcccagagagactcgacccaccaaaaagcgcaccgcggccgcgcagcccttccttcagctctggaacccagcgccccacacctcaaatgggagaactggtgacctctagtggcccatgaccagcctgcagggcctggggctggcggggattctctgacccaaactctcctgggctctaatgctgttcccctgcccaccctaccttctgccttcacactgctgaggggtccgtagccgacaaggaagagctcatttctcatttgtcatgaccatctttaataaaaaataaattagttctgggtgggaaccatatcaggaggcagggagtggggctaggggctgggcggggttggggggggagcgcatgctcacatttctctttttcaccctctgcccagctgggccttgctctggagaggcagtctctttcctcctgccttcctgggtaaggcaggattggcagtggctgaccccagccctagctaattagggaggcaggggcagagatactaggcaaatgagaaggggtcagagacacagggcagcttagaagatgtgaggtctgaacatgagaaatgaggcttagggcacaaaactggagttggtggggagaccacactctaagtagctcagattagcaaggaactgcagacttgctttcctctccacctaggaaagtctcagggaaacaggtcttgtccttctcagtctgtgtaacctctttttgaaaagtgatacacgtttgagcacacacatatccatgcagtcccaaaagcacacctgaggcatatgtgcacacacccatcacaccaccacatgggcctgaccacagccctgaaagtcactttctgtcagtcaccttgccaccctctgtcacctggaggacatccctgctgagactgggacaggctggagagccagggggttcagagtgggccgatcaatgggtgaccgatggtggcacagaaaaccgtgaaggtgccccggacccctttcaggagggatcctggggagaccgctccaggacatgtgcgcaagagcggcaacaggtggctgtgtagtaggggtagacgcagagccgggcctgtaccaccagggggcaatgtggagagctg

SEQ ID NO: 134 - protein, 76 aa, Homo sapiens
MPWASHWIPVLCFTPSYQKGGIWMSGGPSGKAQIPGDFPERLDPPKSAPRPRSPSFSSGTQRPTPQMGELVTSSGP

SEQ ID NO: 135 - DNA, 417 bp, Homo sapiens
atgaatgagttgcgaaaaaagcaactacacaaattcaatgagagaaagggaggagtcctgactcatactttctctactcaacctcccggcccaccccaccccccaggggtcccggcgccatttagctcctccgaagccgccgccattttccgcccccgccggatcgctgctgtgcctcggcagccgctcgcttccctactctgcagcctcagccacgggctccgcccggccctaagagggaggccctggccggaacgtgcggggacggcagctgcaacgtcaggaaggccaggccccgaccccgcccgcagtgccccggcgccgacagcttgcgccagccggcgggagctagcgggcagcaagggggccggacaggctccactgggcggagcggcccgggcggcggttggaacctga

SEQ ID NO: 136 - protein, 138 aa, Homo sapiens
MNELRKKQLHKFNERKGGVLTHTFSTQPPGPPHPPGVPAPFSSSEAAAIFRPRRIAAVPRQPLASLLCSLSHGLRPALRGRPWPERAGTAAATSGRPGPDPARSAPAPTACASRRELAGSKGAGQAPLGGAARAAVGT

SEQ ID NO: 137 - DNA, 1500 bp, Homo sapiens
gccgagcccgggcccagcgccgcctgcagcctcgggaagggagcggatagcggagccccgagccgcccgcagagcaagcgcggggaaccaaggagacgctcctggcactgcagataacttgtctgcatttcaagaacaacctaccagagaccttacctgtcaccttggctctcccacccaatggagatggctctaatggtggcacaaaccaggaaggggaaatctgtggtttaaattctttatgcctcatcctctgagtgctgaaggcttgctgtaggctgtatgctgttaatgctaatcgtgataggggtttttgcctccaactgactcctacatattagcattaacagtgtatgatgcctgttactagcattcacatggaacaaattgctgccgtgggaggatgacaaagaagcatgagtcaccctgctggataaacttagacttcaggctttatcatttttcaatctgttaatcataatctggtcactgggatgttcaaccttaaactaagttttgaaagtaaggttatttaaaagatttatcagtagtatcctaaatgcaaacattttcatttaaatgtcaagcccatgtttgtttttatcattaacagaaaatatattcatgtcattcttaattgcaggttttggcttgttcattataatgttcataaacacctttgattcaactgttagaaatgtgggctaaacacaaatttctataatatttttgtagttaaaaattagaaggactactaacctccagttatatcatggattgtctggcaacgttttttaaaagatttagaaactggtactttcccccaggtaacgattttctgttcaggcaacttcagtttaaaattaatacttttatttgactcttaaagggaaactgaaaggctatgaagctgaatttttttaatgaaatatttttaacagttagcagggtaaataacatctgacagctaatgagatattttttccatacaagataaaaagatttaatcaaaaaatttcatatttgaaatgaagtcccaaatctaggttcaagttcaatagcttagccacataatacggttgtgcgagcagagaatctacctttccacttctaagcctgtttcttcctccatatggggataatactttacaaggttgttgtgaggcttagatgagatagagaattattccataagataatcaagtgctacattaatgttatagttagattaatccaagaactagtcaccctactttattagagaagagaaaagctaatgatttgatttgcagaatatttaaggtttggatttctatgcagtttttctaaataaccatcacttacaaatatgtaaccaaacgtaattgttagtatatttaatgtaaacttgttttaacaactcttctcaacattttgtccaggttattcactgtaaccaaataaatctcatgagtctttagttgatttaaaataaaaaaaaaaaaaaaaaaaaaaaaaaaa

SEQ ID NO: 138 - DNA, 72 bp, Homo sapiens
tgtcgggtagcttatcagactgatgttgactgttgaatctcatggcaacaccagtcgatgggctgtctgaca

SEQ ID NO: 139 - DNA, 85 bp, Homo sapiens
ggctgagccgcagtagttcttcagtggcaagctttatgtcctgacccagctaaagctgccagttgaagaactgttgccctctgcc

SEQ ID NO: 140 - DNA, 2800 bp, Homo sapiens
acatccgggtaccgactccagccgcctagacgctggcactatggtcatggcggaggggacggcagtgctgaggcggaacaggccgggcaccaaggcgcagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaa

SEQ ID NO: 141 - protein, 204 aa, Homo sapiens
MVMAEGTAVLRRNRPGTKAQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 142 - DNA, 2863 bp, Homo sapiens
acatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaa

SEQ ID NO: 143 - protein, 225 aa, Homo sapiens
MVMAEGTAVLRRNRPGTKAQDFYNWPDESFDEMDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 144 - DNA, 2852 bp, Homo sapiens
atttgccaagactgctggcctgttttctaccctgattccttaggtggcttctgggacagaattacggttctctaagtatttgcttgcaggatttctataattggcctgatgaatcctttgatgaaatggacagtacactagctgttcaacagtatattcaacagaacataagagcagattgctccaatattgacaaaattcttgaaccacctgaaggccaagatgaaggtgtgtggaagtatgaacatttaaggcagttctgccttgagctaaatggacttgctgtcaaacttcagagtgaatgccatccagatacttgcactcaaatgacagcaactgaacaatggatttttctttgtgcagctcataaaactccaaaagagtgtcctgctatagactatactagacacacacttgatggtgctgcatgtcttctgaatagcaataaatattttcccagcagggttagcataaaggaatcatctgtagcgaaactaggatcagtatgccgtaggatttacagaatattttcacatgcttattttcatcatcggcagatatttgatgaatatgaaaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatacaaatgcaaatgaagcattagtaatacttaaataattttactgtgctacataaagtataacatacttggaaaggatttaccgttctgcaacaacggactggtacatacaggatgatcacaatggtaaggcacataaattattttcccactggaaacctgccctgtccaccccttctcatttcccttaaccttatcttcaaactactttagctgagaagcttttcaccagactgagttagtggtggcttatacctatttatatttgtattaattgcttacagattatacctcatattagcaattacattacactacaagaaaatgtatttgcataggctcttgcttatctttgttttgcaaaattgttctacttagaaaacagtccttaaaatagtttgactcttcctgttagtaatatattaatctttcatttaaccagctaggcagcattaaatagaattgaagaaataccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtgaaacagttcctgtttttccttaatactgttttcagaattttgaaaatgtacttatatatacataaatactactaaaaaattaa

SEQ ID NO: 145 - protein, 193 aa, Homo sapiens
MDSTLAVQQYIQQNIRADCSNIDKILEPPEGQDEGVWKYEHLRQFCLELNGLAVKLQSECHPDTCTQMTATEQWIFLCAAHKTPKECPAIDYTRHTLDGAACLLNSNKYFPSRVSIKESSVAKLGSVCRRIYRIFSHAYFHHRQIFDEYENETFLCHRFTKFVMKYNLMSKDNLIVPILEEEVQNSVSGESEA

SEQ ID NO: 146 - DNA, 1243 bp, Homo sapiens
ggacgcaaccatctgcggaaaggataggggggaggaagacttaacactgcaacaacaggtacaaaaaagaaggaaactcagtaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcgcagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcggagaaagttattcgctcgattttttctgaatcataattaaactttatgataaaataaaaaaaaaaaaaaa

SEQ ID NO: 147 - protein, 171 aa, Homo sapiens
MSSKRTKTKTKKRPQRATSNVFAMFDQSQIQEFKEAFNMIDQNRDGFIDKEDLHDMLASLGKNPTDEYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 148 - DNA, 2544 bp, Homo sapiens
ggactgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagagagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaa

SEQ ID NO: 149 - protein, 727 aa, Homo sapiens
MNQKLLKLENLLRFHTIYRQLHSLCQRRALRQWRHGFSSAYPVWTAQLCAWPWPTDVLTGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDVSANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 150 - DNA, 2965 bp, Homo sapiens
cggggctgtaggtaggagttaagtgggtaggatcccttaaccagggttgtccggtgcaggtggtgtgtgttgtttcgcctaacgtgtcagtggcacaaatcacgcgaacttcataaacattgtgcgttcggaagcctttccaagatgcatttaatccctgcgtgagcccacgttaggcattcacgaaggcatgtgcactgttctctcggaagcggctggccggcttcccctcctcgcgcgcggctgtgggtgcaggtcctcacttcccagcctcccatgggcccaaggccttctgggctccaatttgaggcgagccaccccagatccgtaatttttctgcagtgatttatttttacctttctgattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggcccataggaaacaagtgacttgctgagtccagataacactgactgtcagaagtctcgctctgtctccccggctggagtgcagtggcgtgatcttggctcactgcaacctctgtctcccgggttcaagaaattctcctgcctcagcctcccaagtagctgggactacaggcatgtgccaccacgcccaggagaaacatgaaccagaagctactgaagttggagaacttgctacgatttcacactatttataggcaactgcacagtctgtgtcaaagaagagcattaagacagtggaggcatgggttttcatctgcttaccctgtgtggacagctcaactgtgtgcctggccctggccaacagatgtgctcactggggctgctttatctcagtataggcttctagtaacaaaaaaggaagaaggaccatggaaatctcagttatcttcaacaaaatctaaaaaggtggtagaagtatggattggaatgactattgaggaactggccagggcaatggaaaaaaacacagattatgtatatgaagctttattgaacactgatattgacatagattcactggaagcagactcacatttagatgaagtctggatcaaagaagtgataacgaaggcagggatgaagttaaagtggagtaaattaaaacaggacaaagtcagaaaaaataaagatgctgtaagaaggccccaggcagatccagctttattaaccccaaggtccccagttgttactataatgggccatgttgatcacgggaaaacgacattacttgacaaatttcgaaaaactcaagtggcagcagtggaaactggaggcatcactcagcacattggtgcctttcttgtctctctgccttctggggaaaagataacttttcttgatactccaggacatgctgctttctcagcaatgagagccagaggtgctcaggtcactgacattgtcgtattggttgtagctgcagatgatggagtgatgaaacaaactgtagaatctattcagcatgccaaagatgcacaggttcctattatccttgccgtaaataaatgtgacaaagctgaggctgatcctgagaaagtgaaaaaagagctgctggcttacgatgtggtatgtgaagattatggaggtgatgttcaagcagtgcctgtctccgcacttacgggcgataatctgatggctttggcagaagcaacagttgctcttgcagaaatgttagaattgaaagcagatcccaatggtccagtggaaggaacagtaatagagtctttcacagacaaaggaagaggtcttgttactacagctataattcaaagaggaactttaagaaaaggctctgttctggttgctggaaaatgttgggcaaaagtacgcttaatgtttgatgaaaatggaaaaacaattgatgaggcctatcccagcatgccagtgggaattacaggctggagagaccttccttctgcaggagaagaaattcttgaagtagaatctgagccaagggcacgtgaagttgttgactggaggaaatatgaacaagaacaggagaaaggtcaggaggatctgaaaataatagaagaaaagcgaaaggaacacaaagaagcacatcagaaagcccgtgagaagtatggccatctactgtggaagaagagatcaattctacggtttttagaaagaaaagaacaaatacccttaaagccaaaagagaaaagggaaagagattcaaatgtactttctgtgattattaaaggtgatgttgatggttctgttgaggccattttgaacattatagatacctatgatgcttcacacgagtgtgaactagaattagtacattttggagtgggtgatgtaagtgcaaatgatgttaaccttgctgaaacatttgatggtgttatatatggctttaatgtgaatgcaggcaatgttatccaacagtcagctgcaaaaaaaggagtaaaaattaaacttcacaaaataatttaccgtcttgttgaagatttgcaagaggaactgagcagcagattaccctgtgctgtggaagagcacccagtaggtgaggcatctatactagctaccttctctgtaacagaagggaagaaaaaagttcctgtggctggctgcagagtccaaaagggacagttagaaaaacaaaaaaaatttaaactaacccgtaatggacatgtaatttggaagggctcattaacctcattgaaacaccataaagatgacatttcaattgtcaaaacgggaatggattgtggtctcagtttagatgaagacaatatggaatttcaagtgggagacagaattgtttgttatgaagaaaagcaaattcaagccaagacttcttgggatccaggattttaaaattacattaaaaatgtaaataactcaaaaaaaaaaaaaaaaaa

SEQ ID NO: 151 - protein, 727 aa, Homo sapiens; identical to SEQ ID NO: 149

SEQ ID NO: 152 - DNA, 7505 bp, Homo sapiens
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgctacga

SEQ ID NO: 153 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 154 - DNA, 1128 bp, Homo sapiens
ggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattcaaaaaaaaaaaaaaaaaaaaa

SEQ ID NO: 155 - protein, 215 aa, Homo sapiens
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 156 - DNA, 1061 bp, Homo sapiens
ggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattcaaaaaaaaaaaaaaaaaaaaa

SEQ ID NO: 157 - protein, 215 aa, Homo sapiens; identical to SEQ ID NO: 155

SEQ ID NO: 158 - DNA, 6650 bp, Homo sapiens
ggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgttaactcctcggcctctgtaatcaagacagattcttatgcaggcccagactctgctggtccgcttctcaaaagttctctcattaccccaacagtggctgcatttcctttggaaagtgctgaccctgccggggtggctcccacaactgccaaaggtacctcaacttatacaactacagccagcccttttctagaaggaactgtctctttagctcctaaaaaccacccagttaaggaaggtactcttactactttacccttggttcctacagcttcagaaaattgccctgtggctccatccccccagaatacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatctgcccttccccaaagagggtccagctactccagcacccaaacaggctcctgctctatccatgacttcttcctcccccaaaaaggcccgagcaactccagcccctaaaggaatcccagcttccccatcccccaaaggggcccccacacccccagctgcaactcctccctcccctaaaggaggcccagctaccccatccccgaaatgggcccccacacccccagctgcaactcctccctccccaaaaggaggtccagctactccatcccccaaaggggcccccacacccccagctgcaactcctccctcccccaaaggaggtccagctactccatcccccaaaggggcccccacacccccagctgtgactcctccctcccccaaaggaagtccagcagctaccccattccccaaaggggcatccacacccccagctgcaactcctccctcccccaaaggaagtccagcagctaccccactccccaaaggggcccccacaaccccagctgcaactcttccctccccaaaaggaggtccagctaccccatccctcaagggggcccccactcccccagctgcgactcctccctccccaaaaggaggcccagctaccccatcccccaaaggggcccccatgcccccagctgcaactcctccctccccaaaaggaggtctagctaccccaccccacaaaggggcacccacaaccccagctgcaactcctccctccccaaaaggaggtctagctaccccacccccaaaaggggcccccacaaccccagctgcaactcctccttccccaaaaggaggtctagctaccccacccccaaaaggggcccccacaaccccagctgcaactcctccttccccaaaaggaggtctagctaccccatcccccaaaggggcccccacaaccccagctgcaactcctccctccccaaaaggaggtctagctaccccatcccccaaaggggcccccacaaccccagctgcaactcctccctccccaaaaggaggtctggctaccccatcccccaaaggggcccccacaaccccagctgcaactcctccctccccaaaaggaggcccagctaccccaccccccaaaggggcccccactcccccagctgcaactcctccctccctaaaaggaggtctagctaccccaccccacaaaggggcccccaatcccgcagttgtaactcctccctctccaaaaggaggcccagctacctcaccccccaaaggggcccccactcctccagctgcaactcctccctccccaaaaggaagcccaggtaccccaccccccaaaggggcccccactcccccagctgtaactcctccctcccctaaagggacccctactctcccagctacaactccctcctctaaaggaggcccaactactccatcctccaaagagggccccactcccccagctgcaaccccctcccacaaaggaggtcccgctatgactcctccctcccccaaaagaggaccagctatcccatctcccaaaggggaccccacttccccagcagtgattcctctctcccccaaaaaggctccagcaactccagtcaccagagaaggcgcagccaccccatccaaaggagatctcactcccccagcagtgactcctgtctccctcaaaaaggccccagcaacttcagcccccaaaggaggcccagctaccccatcctccaaaggggatcccaccctcccagcagtgactcctccttcccccaaggagcccccagcccccaaacaagttgccacttcttcctctcccaaaaaggccccagcaactccagcccccatgggggcccccactctgccagctgtgattccttcttcccccaaagaggtcccagctaccccatcctccagaagggaccccattgccccaacagcgactcttctctctaaaaagaccccagcaactctagcccccaaagaggccctcattcccccagctatgactgttccctcccctaaaaagaccccagcaattccaacccccaaagaagccccagctaccccatcctccaaagaggcctccagtcccccagcagtgactccttccacttacaaaggggccccatcccccaaagagctcctcattccaccagctgtgacttctccttcccccaaagaggcacctactcctccagctgtgactcctccatcccccgaaaagggcccagcaactccagcccccaaagggactcccacttccccacctgtgactccttcctccctcaaagactcccctacttccccagcttctgtcacatgtaaaatgggggccactgttcctcaagcatctaaagggcttccagcaaagaaaggccccacagctctgaaagaagtacttgttgccccagctccagaaagcacgccaatcatcacagctcccactcggaaaggtccacagaccaaaaagagttctgctacttcacctcctatatgcccagatccctcagctaagaatggttctaaaggacccctttccacagtggctccagcccctctactccctgttcagaaagactcttcaaagacagcaaaaggcaaagatgcttctcattccccaaagggccccttggctcctcctgagtctaaggcgtccacccctctaacagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattcaaaaaaaaaaaaaaaaaaaaa

SEQ ID NO: 159 - protein, 2078 aa, Homo sapiens
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIGKPASSMTSPLGVNSSASVIKTDSYAGPDSAGPLLKSSLITPTVAAFPLESADPAGVAPTTAKGTSTYTTTASPFLEGTVSLAPKNHPVKEGTLTTLPLVPTASENCPVAPSPQNTCAPLATLVLAPEIPKSVPSPSLPPAGTPPGTKKVDGISHTSALAPVASSPKECPTEDSGASATASSKGTLTYLADSPSPLGVSVSPQTKRPPTKKGSAGPDTPIGNLSSPVSPVEASFLPENSLSFQGSKDSPATTHSPTPPSPKGAPTPSAVTPLSPKGVTLPPKETPTPSVVNLPFPKEGPATPAPKQAPALSMTSSSPKKARATPAPKGIPASPSPKGAPTPPAATPPSPKGGPATPSPKWAPTPPAATPPSPKGGPATPSPKGAPTPPAATPPSPKGGPATPSPKGAPTPPAVTPPSPKGSPAATPFPKGASTPPAATPPSPKGSPAATPLPKGAPTTPAATLPSPKGGPATPSLKGAPTPPAATPPSPKGGPATPSPKGAPMPPAATPPSPKGGLATPPHKGAPTTPAATPPSPKGGLATPPPKGAPTTPAATPPSPKGGLATPPPKGAPTTPAATPPSPKGGLATPSPKGAPTTPAATPPSPKGGLATPSPKGAPTTPAATPPSPKGGLATPSPKGAPTTPAATPPSPKGGPATPPPKGAPTPPAATPPSLKGGLATPPHKGAPNPAVVTPPSPKGGPATSPPKGAPTPPAATPPSPKGSPGTPPPKGAPTPPAVTPPSPKGTPTLPATTPSSKGGPTTPSSKEGPTPPAATPSHKGGPAMTPPSPKRGPAIPSPKGDPTSPAVIPLSPKKAPATPVTREGAATPSKGDLTPPAVTPVSLKKAPATSAPKGGPATPSSKGDPTLPAVTPPSPKEPPAPKQVATSSSPKKAPATPAPMGAPTLPAVIPSSPKEVPATPSSRRDPIAPTATLLSKKTPATLAPKEALIPPAMTVPSPKKTPAIPTPKEAPATPSSKEASSPPAVTPSTYKGAPSPKELLIPPAVTSPSPKEAPTPPAVTPPSPEKGPATPAPKGTPTSPPVTPSSLKDSPTSPASVTCKMGATVPQASKGLPAKKGPTALKEVLVAPAPESTPIITAPTRKGPQTKKSSATSPPICPDPSAKNGSKGPLSTVAPAPLLPVQKDSSKTAKGKDASHSPKGPLAPPESKASTPLTAAAFEKVLPKPESASVSAAPSPPVSLPLAPSPVPTLPPKQQFLPSSPGLVLESPSKPLAPADEDELLPLIPPEPISGGVPFQSVLVNMPTPKSAGIPVPTPSAKQPVTKNNKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 160 - DNA, 1102 bp, Homo sapiens
ggttccgcgttccctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattcaaaaaaaaaaaaaaaaaaaaa

SEQ ID NO: 161 - protein, 215 aa, Homo sapiens; identical to SEQ ID NO: 155

SEQ ID NO: 162 - DNA, 5125 bp, Homo sapiens
aaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactgtaatagcctaaacacaactcttatttacttacagccttatgtttttgtattttcttggtagactaggtaatttttttttaaaggacaggaaactgatattttaaagaccaatttgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttttgtaattttttccttgaagaaccaaagtattttttcagctggttgttgaatagggttaagtccgcttggattagctgtgcctttcattactttgttacagaaatgcagtgacttatactaagacaatttattgtttaaaaaaaaaattggcaagacaactatatggttaagaatttccagtatgaccacacccaataactgttattagagtgttaatggattattgtgttttaggtgacatagttaactgtaaagtaacctgactcagtatagttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagcc

SEQ ID NO: 163 - protein, 391 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 164 - DNA, 4451 bp, Homo sapiens
aaaagatatggtggggtgcttaacagaggaggttagacaccggcgggaaccagaggagcccaagcgcggcgcctgggcctcggggctgcaggagtcctcggtgggggtatggaggtcgccggggaaggaggacggttcagttgctaggcaacccggcctggacccgcctctcgctcgcgttgctgggagactacaaggccgggaggagggcggcgaaagggccctacgtgctgacgctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagaaaatcttaagtgattgatgctgttttcttttaaaaaaaaaaaaaaaaattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctgggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggataaaaagcc

SEQ ID NO: 165 - protein, 391 aa, Homo sapiens; identical to SEQ ID NO: 163

SEQ ID NO: 166 - DNA, 7940 bp, Homo sapiens
tcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgaggacttctttactgataatgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgccagaaaaccatgcatctaaagttgaaggtgataataccaaagaaagagacttggatagagccagtgagaaggtggaacctagagatgaagatttggtggtagctcagcaaataaatgcccaaaggcccgagccccagtcagacaatgattccagtgccacgtgcagcgctgatgaggatgtggatggagagccagagaggcagagaatgtttcctatggactcaaagccttcactgttaaaccccactggatctatactcgtctcatctccgttaaaaccaaatccactggatctgccacagcttcagcatcgagctgctgttatcccaccaatggtatcctgcaccccatgtaacataccaattggaaccccagtgagcggctatgctctctaccagcgacacattaaagcaatgcatgagtcagcactcctggaggagcagcggcagagacaagaacagatagatttggaatgtagaagttctacaagtccatgtggcacatccaagagtccaaacagagagtgggaagtccttcagcctgctccacatcaagtgataactaatctccctgaaggcgttcggcttccgacaactcgaccaaccaggccaccgccccctctcatcccgtcatccaaaaccacagtggcttcagaaaaaccatcttttataatgggaggctccatctcacagggaacaccaggcacttatttgacttctcataatcaggcttcctacactcaagaaacacccaagccgtcagtgggatctatctctcttggactgccacggcaacaggaatctgccaaatcagctactttgccctacatcaagcaggaagaattttctccccgaagccaaaactcacaacctgagggtctgttggtcagggcccaacatgaaggtgtagtcagaggtaccgcaggagccatacaagaaggaagtataactcggggaactccaaccagcaaaatttcagtggagagcattccatccctacggggctctatcactcagggcaccccggctctgccccagactggcataccaacagaggctttggtgaaggggtccatttcgagaatgcccattgaagacagcagtcctgagaaaggcagagaggaagctgcatccaaaggccatgttatttatgaaggcaaaagtggacatatcttgtcatatgataatattaagaatgcccgagaagggactaggagtccaagaacagctcatgaaatcagtttaaagagaagctatgaatcagtggaaggaaatataaagcaagggatgtcaatgagggagtctcctgtatcagcaccgttagaggggctgatatgccgagcattacccagggggagtcctcattctgacctcaaagaaaggactgtattgtctggctccataatgcaggggacaccaagagcaacaactgaaagctttgaagatggccttaaatatcccaaacaaattaaaagggaaagtcctcccatacgagcatttgaaggtgccattaccaaaggaaaaccatatgatggcatcaccaccatcaaagaaatggggcgttccattcatgagattccaaggcaagatattttaactcaggaaagtcggaaaactccagaagtggtccagagcacacggccgataattgagggttccatttcccagggcacaccaataaagtttgacaacaactcaggtcaatctgccatcaaacacaatgtcaaatccttaatcacggggcctagcaaactatcccgtggaatgcctccgctggaaattgtgccagagaacataaaagtggtagaacggggaaaatatgaggatgtgaaagcaggcgagaccgtgcgttcccggcacacgtcagtggtaagctctggcccctccgttcttaggtccacactgcatgaagctcccaaagcacaactgagccctgggatttatgatgacaccagtgcacggaggacccctgtgagttatcaaaacaccatgtccagaggctcacccatgatgaacagaacttctgatgttacaatttcttctaacaagtctaccaatcatgaaaggaaatcgacactgacccctacccagagggaaagtatcccagcgaagtctccagtgcctggggtggaccctgtcgtgagccacagtccgtttgatccccatcacagaggcagcactgcaggcgaggtttatcggagccacctgcccacgcacttggatccagccatgccttttcacagggctttggatcctgcagcggctgcttacctgtttcagagacagctttcaccaactccaggttacccaagtcagtatcagctttacgcaatggagaacacaagacagacaatcttaaatgattacattacctcacaacagatgcaagtgaacttgcgtccagatgtggccagaggactctccccaagagagcagccactgggtctcccatacccagcaacgagaggaatcattgacctgaccaatatgcctccaacaattttagtgcctcatccagggggaacaagcactcctcccatggacagaatcacttatattcctggtacacagattactttccctcccaggccgtacaactctgcttccatgtctccaggacacccaacacaccttgcagctgctgcaagtgctgagagggaacgggaacgggagcgggagaaggagcgggagcgggaacggattgctgcagcttcctccgacctctacctgcggccaggctcagaacagcctggccgacctggcagtcatggatatgttcgctccccttccccttcagtaagaactcaggagaccatgttgcaacagagacccagtgttttccaaggaaccaatggaaccagtgtaatcacacctttggatccaactgctcagctacgaatcatgccactgcctgctgggggcccttcaataagccaaggcctgccagcctcccgttacaacactgctgcggatgccctggctgctcttgtggatgctgcagcttctgcaccccagatggatgtgtccaaaacaaaagagagtaagcatgaagctgccaggttagaagaaaatttgagaagcaggtcagcagcagttagtgaacagcagcagctagagcagaaaaccctggaggtggagaagagatctgttcagtgtttatacacttcttcagcctttccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctagtagcttatcttctcacaggtatgaaacacctagcgatgctattgaggtgataagtcctgccagctcacctgcgccaccccaggagaaactgcagacctatcagccagaggttgttaaggcaaatcaagcggaaaatgatcctaccagacaatatgaaggaccattacatcactatcgaccacagcaggaatcaccatctccccaacaacagctgcccccttcttcacaggcagagggaatggggcaagtgcccaggacccatcggctgatcacacttgctgatcacatctgtcaaattatcacacaagattttgctagaaatcaagtttcctcgcagactccccagcagcctcctacttctacattccagaactcaccttctgctttggtatctacacctgtgaggactaaaacatcaaaccgttacagcccagaatcccaggctcagtctgtccatcatcaaagaccaggttcaagggtctctccagaaaatcttgtggacaaatccaggggaagtaggcctggaaaatccccagagaggagtcacgtctcttcggagccctacgagcccatctccccaccccaggttccggttgtgcatgagaaacaggacagcttgctgctcttgtctcagaggggcgcagagcctgcagagcagaggaatgatgcccgctcaccagggagtataagctacttgccttcattcttcaccaagcttgaaaatacatcacccatggttaaatcaaagaagcaggagatttttcgtaagttgaactcctctggtggaggtgactctgatatggcagctgctcagccaggaactgagatctttaatctgccagcagttactacgtcaggctcagttagctctagaggccattcttttgctgatcctgccagtaatcttgggctggaagacattatcaggaaggctctcatgggaagctttgatgacaaagttgaggatcatggagttgtcatgtcccagcctatgggagtagtgcctggtactgccaacacctcagttgtgaccagtggtgagacacgaagagaggaaggggacccatcacctcattcaggaggagtttgcaaaccaaagctgatcagcaagtcaaacagcaggaaatctaagtctcctatacctgggcaaggctacttaggaacggaacggccctcttcagtctcctctgtacattcagaaggggattaccataggcagacgccagggtgggcctgggaagacaggccctcttcaacaggctcaactcagtttccttataaccctctgactatgcggatgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtaaaaaaaaaaaaaaaaaaaaaaaaaa

SEQ ID NO: 167 - protein, 2440 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 168 - DNA, 2185 bp, Homo sapiens
aatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 169 - protein, 428 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 170 - DNA, 2401 bp, Homo sapiens
ccccccctcgccggggaccgagcgcgctcgctccggcgccggcctcgcctcctcgcagcagcgccatggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgagatgcagagcaaagcggcagtccccggacagggatgggctctgaccaggaggacagcaagcccatcacgctggacacgaccgacttccaggagagctttgtcacctccggcgtgttcagcgtcactgagctcatccaagtgtcccggacacccgtggtgactggaacaggacccaacttctccctgggggagctgcaggggcacctggcatacgacctgaacccagccagcactggcctcagaagaacgctgcccagcacctcctccagtgggagcaagcggcacaaatcgggctcgatggaggaagacgtggacacgagccctggcggcgattactacacttcgcccagctcgcccacgagtagcagccgcaactggacggaggacatggaaggaggcatctcgtccccggtgaagaagacagagatggacaagtcaccattcaacagcccgtccccccaggactctccccgcctctccagcttcacccagcaccaccggcccgtcatcgccgtgcacagcgggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccgttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttcctactctccgcccgacacgtcccctgcaaaccgttcctttgtgggattaggaccaagggatcctgcgggcatttatcaggcacagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctcta

SEQ ID NO: 171 - protein, 499 aa, Homo sapiens
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 172 - DNA, 7011 bp, Homo sapiens
agttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactggggagaatttcgatcgccaggccagccttcggcggtctctaatttacacagacactctggtaagacgaccgaagaaagtcaaaaggagaaagactattacaggagtccctgacaacatacagaaggagctagcatcaggcactggccaagatgatgctgatggccactcagtgtacacccctgatcactactctacactaggaaggttcaatagctgtcggtctgctgggcagcgctcagaaaccagggactccagctgtcagacggaggatgtgaaggtcgtaccaccttccatgaggagaatcagggcacagaaggggcaaggcattgctgcccagatgggccacttctcaggttcctctggcaacatgtctgtgctgagcgattctgcagggatcgtattcccttcccgccttgacagtgatgctggcttccatagtcttccgcgttctggagcaagggcaaacattcagtcccttgagccgaggctgggtgccctcggccctgcaggagacatgaatggcactttcctctaccagagaggtcacccacaagcagatgaaaacttaggccatttaggaggtgcctcagggactggaacacttttgagacccaaatcccaggagttgagacacttcgagagtgaaaatataatgagcccagcgtgtgtggtttctcctcatgcaacctactccaccagcatcatcccaaatgccacactgtcttcctcttccgaggtcatcgctattcccactgctcagagtgcgggacagcgggaaagtaaaagttctggctcatcacatgcaaggataaaatccagagaccacctcatctccaggcatgctgtgaaaggtgatcctcagtctcccggtcgccactggaatgagggccatgccaccattctttcacaggacttagaccctcattcccctggtgaacccgcactgttgtccctctgtgactcagccgtccctctaaatgctccagcaaatagggagaatgggtcccaagctatgccgtataattgtagaaacaacctggccttcccagcccacccccaagatgtggatggcaagagtgaatctagttattcagggggcggagggcacagcagctcggagccctgggaatacaaatcctcaggtaatggaagggcatcccccctgaagccgcatttagcaactcctggctattccactcccacaagtaacatgagcagctgcagtttggaccaaacgtccaacaaagaggatgctgggtcgctgtattctgaggaccacgatggctactgtgcatctgtgcacactgactctggacatggatctgggaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcaggattcccaagaagagcagccagtgcaacgggcaggtgctcaacgagagcctgatcgccacactccagcactcgctgcagctgagcctcccaggcaagagtggcagctcgccctcccagagcccctgcagtgacttggaagagccctggctgccccgctcccggagccagagcacagttagtgctggcagcagcatgacttccgccaccacccccaatgtctactccctgtgcggggccacgccatcgcagagtgacacaagcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccccggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttttaaccagagtttaaacttccattaggcaatttcctgtcacttgaaatgtcaacatttgctaacttttggatatccttttggttacaccaaagaaaaagttatggctatttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcattagaaggacctaggatgacaatgcggagagtcttggtctgaatctagtgcgactaccacctgccagcttttggggggtatggaaatactatctaaaagttggactgcatgggtcaaatcattatgagacttataaactaaaactttagatacccatatagaaatgtctttgaggcaaaaacaaacctaaagaatgaaggctctttcccttctctgaaaaaaacaaaacactgctcttcacacaaccggaagtcaagaccagagatttggagcaattgtctactaatttggcacaaagatcgtttctttagaaaagtggcattggcttttgaatatgaaatcttctcatagctgcctaaaaaagactagaatgtatatggatatcagaaacctttaataatacataatttatgcaaagataagataaagcaacataacactaattataaaactatttttaaatccccatttttaatgaaaaatatacatttgtatttaatttcctttgaataaaacaattgtaaagtaaa

SEQ ID NO: 173 - protein, 1606 aa, Homo sapiens
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITGENFDRQASLRRSLIYTDTLVRRPKKVKRRKTITGVPDNIQKELASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 174 - DNA, 1419 bp, Homo sapiens
tactcgctgtgactgtgtgcatgtggctctctccctgggcctcagttttcccatgtgaggaacggggatagtaacacaggctggctgtgaagatgaacattaatccatgcctggtgctttgtgagtgctcactgagtattagccttgatgcagacccactggtttctccttttgccactgggccctgccctggagctcccagggaggtggtggcgatgcagagcgacgtgggtcagggattccccatgcagtccaactggagggctcccgtgcatgcgtgcacatcaggggcggtaaggaagggctggccggggtgtgggaggaggcgacacaagatgggaggtggccctgtctcttgggagcaaaggcagaaggaggtggaggcagctcagggctcggaggagaggggtccgggctccttggctgtgtccctgctgtctctcgctgtgggtattcaccgaatctctcccatcctcggttttcacatctgctgcatgcaggtcctcatggttctcaagtgaggcaggtggtgagcccatcaggccagtgcccagggcttattctggggacagctcctggagaggaagggctgcctccctaaggactcctgccctgccctgggtgcaaggggttccacctgctgcccctcccccactccccagctcgcctcaggcggatagttcccctctcactccaaataagagccacaatgctgacagtggcccccaaggccctgcccagcggtccccagcttcctctagctacatctcccggccctccccttcacccactcctgtaggcgcctcgaacgcgcctcagccctgctcctcccctgcctgcagcgttcctccccaggtctcccccggctctctcacctgcttccggttttgctcagactgcgctgcctcagtgcgcccttctgtcaccatcctgtgtatagtcggaaacccctgctccctttccctgcactgaatcttccgtgtgctccttttctccatggcatttgttagctttggctatcctgtctaatttgcgtatgtatttattttttattttgctgcctgttccctcattcccccaactccccaatggcagggagttctgttttggtcactgctgaatccctggtgacccgagcagtgatgatgcagagttgttgtgatatttgtggaatgaatgaatgcaggattttttgttttaccttcacttggcacaaatgctgtggttctgttcaccactcccccctgaagtaatgaaagttatgggcccatccctgtgctgagtggagctggggacacagtgggggctaggacagactgtatccctgccttgtggaacccacagtccagtgggagaggcgacattacccacatagtcatgcaggtgacagaggcaagtgctgtgaggggaagggaaggc

SEQ ID NO: 175 - protein, 142 aa, Homo sapiens
MNINPCLVLCECSLSISLDADPLVSPFATGPCPGAPREVVAMQSDVGQGFPMQSNWRAPVHACTSGAVRKGWPGCGRRRHKMGGGPVSWEQRQKEVEAAQGSEERGPGSLAVSLLSLAVGIHRISPILGFHICCMQVLMVLK

SEQ ID NO: 176 - DNA, 1225 bp, Homo sapiens
gatgacgcaagagcccgctctcacttttcagcggcaggcgaagggggctgaggaaaggaggtgggtctaggcaggggaaattggggtgccaccagacggagacagcttggactaccagaatcaagcactcttttggaagagggtaatctctctccaaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgcagtgtcaaaaaaaaaaaaa

SEQ ID NO: 177 - protein, 247 aa, Homo sapiens
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYCPQIGCSHTDIRKSDLIQDEALRRAIENHNKKRHRHSE

SEQ ID NO: 178 - DNA, 2306 bp, Homo sapiens
attcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaaaaaaaaaaaa

SEQ ID NO: 179 - protein, 245 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 180 - DNA, 1906 bp, Homo sapiens
attcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaaaaaaaaaaaa

SEQ ID NO: 181 - protein, 194 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQVKVNKYGDTWDE

SEQ ID NO: 182 - DNA, 1951 bp, Homo sapiens
attcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaaaaaaaaaaaa

SEQ ID NO: 183 - protein, 187 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGRNFS

SEQ ID NO: 184 - DNA, 1754 bp, Homo sapiens
attcctaggctgctggctctcagacccgcagtgaggtctgacgtcatttcctgccgaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaactcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaaaaaaaaaaaa

SEQ ID NO: 185 - protein, 187 aa, Homo sapiens; identical to SEQ ID NO: 183

SEQ ID NO: 186 - DNA, 2059 bp, Homo sapiens
attcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgcaacagccctcatcttccttgattttatggttttattgtttgtaatttattgatttatttttaagctagttataatcatgtaggtataggaaataaagtcatctataatatttctataatatggctataatatggctataaatctataatatggctggaggcagtgggcagtggttcatgcctgtaatcccagcactttgggaggccgaagtgggaggattgcatgagtccaggagtttgagaccagcctgggcaacaaagcgagaccctgtctttacaaaaaaataaaaattagctggcgatggtgtcgtgtgcctgtagtcctagttacttaagaggctgagttgggaggatcagttgaacccagtggttctgggttgcagtgagctgtggtcacaccactgaactccagcctgtgcgactgagtgagaccctgtgtctaaaaaaataaaaatataatgaatgtgatttatgtagataaattgataatatagtaaataggtaaatgccttaaaaagcatttttaaagaatttgtaaattctaaaacaataaaaatttggtatacatcaaaaaaaaaaaa

SEQ ID NO: 187 - protein, 245 aa, Homo sapiens; identical to SEQ ID NO: 179

SEQ ID NO: 188 - DNA, 2818 bp, Homo sapiens
ggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 189 - protein, 436 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 190 - DNA, 2793 bp, Homo sapiens
ggggcatgccgggagtggttgtgtacggtccgcagcggcaggtgaagtctagcagaggacgcggccaggcgattcggtgaagcgattcctgcaggcgttggttcccctctttgacctggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 191 - protein, 436 aa, Homo sapiens; identical to SEQ ID NO: 189

SEQ ID NO: 192 - DNA, 2795 bp, Homo sapiens
gtggctgctcctgggtgtagtgagatgtctccagccagggccaagcagcagcagtagcagcagcagcagtagcagcagcagcagcaacagcagcagcagcagcaacagcagcagcaaagggatttgaatttgttgaaatgagcagtcgtaaatcaaagagtaacagcttaattcacacagagtgcctttcacaggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgaggatcaggaaaaactatgttaataaatcatgctttgaaagaactcatggaaatagaagaagtgagtgaaaatgtattacaagttcacttaaatggactgctgcagatcaatgacaaaatcgccctaaaggaaatcacaaggcagttaaatctggaaaatgtagttggagataaagtttttggaagctttgctgaaaacctttcatttcttctggaagctttaaaaaaaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcagtatctctcagaagatagaagtgtgcaagaagtactacagaagcatttcaatatcagcaaaaacctgcggtcattacacatgctattgatgcttgctttaaatcgagtaacagcatcgcacccatttatgactgccgtagatctaatggaagcaagccaactgtgtagcatggactcgaaagcaaatattgtacatggtctatcagtcttggaaatctgtcttataatagcaatgaaacatttaaatgacatctatgaggaagagccatttaattttcaaatggtctataatgagtttcagaagtttgttcaaaggaaagcacattccgtttataattttgaaaaacctgttgtcatgaaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 193 - protein, 436 aa, Homo sapiens; identical to SEQ ID NO: 189

SEQ ID NO: 194 - DNA, 4283 bp, Homo sapiens
ggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaaaaaaaaaaaaaa

SEQ ID NO: 195 - protein, 312 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 196 - DNA, 2041 bp, Homo sapiens
aggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaagatccacctccgacccttaagccagagactcagccaccagagaaacggcggagaacaattgaggatttcaacaaattctgcagttttgttttggcatatgctggttacattccccctagcaaagaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttataaaaa

SEQ ID NO: 197 - protein, 403 aa, Homo sapiens
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 198 - DNA, 1163 bp, Homo sapiens
ctactgcgcaggctcagtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccaaaaaaaaaaaa

SEQ ID NO: 199 - protein, 252 aa, Homo sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 200 - DNA, 949 bp, Homo sapiens
ggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtgtcctgccatcccaaaaaaaaaaaaaaaaaa

SEQ ID NO: 201 - protein, 140 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRVTPK

SEQ ID NO: 202 - DNA, 3810 bp, Homo sapiens
gggcacaggggagactaaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcaaaaaaaaaaaaaaaaa

SEQ ID NO: 203 - protein, 349 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 204 - DNA, 3755 bp, Homo sapiens
gggcacaggggagactaaaaaggccagggaagttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttcaaaaaaaaaaaaaaaaa

SEQ ID NO: 205 - protein, 349 aa, Homo sapiens; identical to SEQ ID NO: 203

SEQ ID NO: 206 - DNA, 2791 bp, Homo sapiens
tgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcca

SEQ ID NO: 207 - protein, 524 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 208 - DNA, 2809 bp, Homo sapiens
tgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggcgtttagagaaaatggcagacgatattgatattgaagcaatgcttgaggctccttacaagaaggatgagaacaagttgagcagtgccaacggccatgaagaacgtagcaaaaagaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttactccggaccaaaatttaacagtgccatccgaggaaagattgggttgcctcatagcatcaaattaagcagacgacgttcccgaagcaaaagtccattcagaaaagacaagagccctgtgagagaacctattgataatttaactcctgaggaaagagatgcaaggacagtcttctgtatgcagctggcggcaagaattcgaccaagggatttggaagagtttttctctacagtaggaaaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggcagaaaaaaacagagctgcagcaatggcaaacaatttacaaaagggaagtgctggacctatgaggctttatgtgggctcattacacttcaacataactgaagatatgcttcgtgggatctttgagccttttggaagaattgaaagtatccagctgatgatggacagtgaaactggtcgatccaagggatatggatttattacattttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtacaggtttgcagattccgccagcagcacagcaagctctacagatgagtggctctttggcatttggtgctgtggcagaattctcttttgttatagatttgcaaacaagactttcccagcagactgaagcttcagctttagctgcagctgcctctgttcagccacttgcaacacaatgtttccaactctctaacatgtttaaccctcaaacagaagaagaagttggatgggataccgagattaaggatgatgtgattgaagaatgtaataaacatggaggagttattcatatttatgttgacaaaaattcagctcagggcaatgtgtatgtgaagtgcccatcaattgctgcagctattgctgctgtcaatgcattgcatggcaggtggtttgctggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggcca

SEQ ID NO: 209 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 210 - DNA, 2457 bp, Homo sapiens
ggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaaaaaaaaaaaaaaaaaaaaaaaaaaaa

SEQ ID NO: 211 - protein, 252 aa, Homo sapiens
MEDGVAGPQLGAAAEAAEAAEARARPGVTLRPFAPLSGAAEADEGGGDWSFIDCEMEEVDLQDLPSATIACHLDPRVFVDGLCRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 212 - DNA, 2302 bp, Homo sapiens
ccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaaaaaaaaaaaaaaaaaaaaaaaaaaaa

SEQ ID NO: 213 - protein, 117 aa, Homo sapiens
MKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 214 - DNA, 2434 bp, Homo sapiens
tgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaaaaaaaaaaaaaaaaaaaaaaaaaaaa

SEQ ID NO: 215 - protein, 197 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPASPPVGWKQVEDATPVINYDLLYAISKLGPGEKYELHAATDTTPSVVVHVCESDQEKEEEEEMERMRRPKPKIIQTRRPEYTPIHLS

SEQ ID NO: 216 - DNA, 2532 bp, Homo sapiens
tgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaaggtgcctgcgggccgagccctcctgaccagaaaacccgaccagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 217 - protein, 452 aa, Homo sapiens
MSPKRIAKRRSPPADAIPKSKKVKDTRAAASRRVPGARSCQGACGPSPPDQKTRPVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 218 - DNA, 2490 bp, Homo sapiens
tgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 219 - protein, 438 aa, Homo sapiens
MSPKRIAKRRSPPADAIPKSKKVKDTRAAASRRVPGARSCQVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 220 - DNA, 2439 bp, Homo sapiens
tgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 221 - protein, 421 aa, Homo sapiens
MSPKRIAKRRSPPADAIPKSKKVKVSHRSHSTEPGLVLTLGQGDVGQLGLGENVMERKKPALVSIPEDVVQAEAGGMHTVCLSKSGQVYSFGCNDEGALGRDTSVEGSEMVPGKVELQEKVVQVSAGDSHTAALTDDGRVFLWGSFRDNNGVIGLLEPMKKSMVPVQVQLDVPVVKVASGNDHLVMLTADGDLYTLGCGEQGQLGRVPELFANRGGRQGLERLLVPKCVMLKSRGSRGHVRFQDAFCGAYFTFAISHEGHVYGFGLSNYHQLGTPGTESCFIPQNLTSFKNSTKSWVGFSGGQHHTVCMDSEGKAYSLGRAEYGRLGLGEGAEEKSIPTLISRLPAVSSVACGASVGYAVTKDGRVFAWGMGTNYQLGTGQDEDAWSPVEMMGKQLENRVVLSVSSGGQHTVLLVKDKEQS

SEQ ID NO: 222 - DNA, 1613 bp, Homo sapiens
ggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggcaaaaaaaaaaaaaaaaaaaaaaa

SEQ ID NO: 223 - protein, 320 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 224 - DNA, 1715 bp, Homo sapiens
ggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggcaaaaaaaaaaaaaaaaaaaaaaa

SEQ ID NO: 225 - protein, 354 aa, Homo sapiens
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 226 - DNA, 942 bp, Homo sapiens
tacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 227 - protein, 184 aa, Homo sapiens [sequence omitted]

SEQ ID NO: 228 - DNA, 693 bp, Homo sapiens
tacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaaggaaaaaaaaaaaaaaa

SEQ ID NO: 229 - DNA, 593 bp, Homo sapiens
acccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaa

SEQ ID NO: 230 - protein, 25 aa, Homo sapiens [sequence omitted]

SEQ ID NO: 231 - DNA, 478 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaa

SEQ ID NO: 232 - protein, 25 aa, Homo sapiens [sequence omitted]

SEQ ID NO: 233 - DNA, 751 bp, Homo sapiens
aaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttaaaaaaaaaaaaaaaaaa

SEQ ID NO: 234 - protein, 156 aa, Homo sapiens
MQIFVKTLTGKTITLEVEPSDTIENVKAKIQDKEGIPPDQQRLIFAGKQLEDGRTLSDYNIQKESTLHLVLRLRGGAKKRKKKSYTTPKKNKHKRKKVKLAVLKYYKVDENGKISRLRRECPSDECGAGVFMASHFDRHYCGKCCLTYCFNKPEDK

SEQ ID NO: 235 - DNA, 3031 bp, Homo sapiens
gtggtagcggttattcggcggcccgcggcggaccatggccctggccctggcccggcgtcgctgggctttcctcacggcgtccccgagcagcgtcgcagagcgggccgacttccgggaaggaactgaccagcgactgagcggcggccggcgcgcttagcgccctgaacatgcggcagtccctgcgggcgaccccgggctccggacaggcggcggcggaggcggcggctcgggagggaaggaggcggcggcgccggcggaggtggcggcggagacggccggcgcccggcgcggagccctagggaggcagttcagcgcggcctcgggcctcgtcgagaaggatgctgtcccgaaagaaaaccaaaaacgaagtgtccaagccggccgaggtgcaggggaagtacgtgaagaaggagacgtcgcctctgcttcggaatcttatgccttcattcatccggcatggtccaacaattccaagacgaactgatatctgtcttccagattcaagccctaatgccttttcaacttctggagatgtagtttcaagaaaccagagtttccttagaactccaattcaaagaacacctcatgaaataatgagaagagaaagcaacagattatctgcaccttcttatcttgccagaagtctagcagatgtccctagagagtatggttcttctcagtcatttgtaacggaagttagttttgctgttgaaaatggagactctggttcccgatattattattcagacaatttttttgatggtcagagaaagcggccacttggagatcgtgcacatgaagactacagatattatgaatacaaccatgatctcttccaaagaatgccacagaatcaggggaggcatgcttcaggtattgggagagttgctgctacatctttaggaaatttgactaaccatggttctgaagatttaccccttcctcctggctggtctgtggactggacaatgagagggagaaaatattatatagatcataacacaaatacaactcactggagccatcctcttgagcgagaaggacttcctcctggatgggaacgagttgagtcatccgaatttggaacctattatgtagatcacacaaataagaaggcccaatacaggcatccctgtgctcctagtgtacctcggtatgatcaaccacctcctgtcacataccagccacagcaaactgaaagaaatcagtcccttctggtacctgcaaatccatatcatactgcagaaattcctgactggcttcaggtttacgcacgagcccctgtgaaatatgaccacattctgaagtgggaactcttccagctggctgacctggatacataccagggaatgctaaagttgctcttcatgaaagaattggagcagattgttaaaatgtatgaagcatacagacaagcccttcttacagagttggaaaaccgaaagcagagacagcagtggtatgcccaacaacatggaaaaaatttttgagctgattttttaaaaatttaagttttgtaagagctttaaaatattttcacagataaaaaattgcaaacaagtactctggttaataaatgctgcttcctttgtggaaattataaaattctaactttacatgtattttgttattagaaattttcttttattgaatgagaaaaattagtctatcattttaagagccaatatggcaaacactttcaaatactgtatattaggaaactgttttggtattcttgatggaaaaaaacgcagcggaaatgtcattatgaacagatgttaaataggaaattattacttgttaacttcttacagcagtagtaccttctttaaaaaaaaaaaagaatctgcggtatttttttaaaaaaaaagtttaccgctgtagtgtgaaatattgtctggaaagggatggtttaaatattaccatgatgtagttgaaatataaaataggatttggaaccttattgtgataaatatttatatatgatgtatgtttgtctcccctctccaaagtaaggaacccagctgggcgtggtggctcactcctgtaatcccagcattttgggaggccgaggtgggtggaccgcttgagtccacgagtttaagaccagcctgggcaacatggtgaagccccatctctacaaaaaatacaaaaaaattagccgggtatgatggtgtgtgcctctagtcccagctacttgggaggctgaggtcagaggatggcttgagcccaagaggcagaggttgcagggtcaagatcgcaccacttgcactgcagcctgagagagagagagccagaccttgtctcaaaaaataaaaaataaaaaaataaaaacaaaataaggaatccttttaaagcatgttgagaaagtattttttggtatgaatgggtgacgggccttttaatctttcaggaatacatataagcaggaatacttagcctgtattgggaaggtgcgtgaaactcaaagttgctaacatcatcttccttattttcagccagtgctgttactgcatttagcatggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggactttaacaccatatatttccctcccagtttttctccccttttggtttaatagttaaaacatttttcataattagtgctgtacatttgattgcaaacaaattggtgatacttctaaactataactataaatctctagaattctgtgaatttcaacattatttgaagtagttcttcagttatatttacatgtgttgtaaatatgtaaatatacttttagcttaggaagtcttccagaatacaaactactcccagttagatatcagtgagtttgaataactgaagaaatgttgacaatgttaagtgtttgattttatataacaagcttattaaatatatttttgtgg

SEQ ID NO: 236 - protein, 383 aa, Homo sapiens
MLSRKKTKNEVSKPAEVQGKYVKKETSPLLRNLMPSFIRHGPTIPRRTDICLPDSSPNAFSTSGDVVSRNQSFLRTPIQRTPHEIMRRESNRLSAPSYLARSLADVPREYGSSQSFVTEVSFAVENGDSGSRYYYSDNFFDGQRKRPLGDRAHEDYRYYEYNHDLFQRMPQNQGRHASGIGRVAATSLGNLTNHGSEDLPLPPGWSVDWTMRGRKYYIDHNTNTTHWSHPLEREGLPPGWERVESSEFGTYYVDHTNKKAQYRHPCAPSVPRYDQPPPVTYQPQQTERNQSLLVPANPYHTAEIPDWLQVYARAPVKYDHILKWELFQLADLDTYQGMLKLLFMKELEQIVKMYEAYRQALLTELENRKQRQQWYAQQHGKNF

SEQ ID NO: 237 - DNA, 2408 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 238 - protein, 661 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 239 - DNA, 2318 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatccgactgcctcggcctccggaagtgctgggattacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 240 - protein, 631 aa, Homo sapiens
MELQPPEASIAVVSIPRQLPGSHSEAGVQGLSAGDDSETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 241 - DNA, 2222 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 242 - protein, 599 aa, Homo sapiens
MELQPPEASIAVVSIPRQLPGSHSEAGVQGLSAGDDSETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 243 - DNA, 2129 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 244 - protein, 568 aa, Homo sapiens
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 245 - DNA, 1997 bp, Homo sapiens
agtccccgaggttccaccttaaggggcgggccggggcggggctccgctgccccttcccagaggccgcgcctgctgctgagcagatgcagtagccgaaactgcgcggaggcacagaggccggggagagcgttctgggtccgagggtccaggtaggggttgagccaccatctgaccgcaagctgcgtcgtgtcgccggttctgcaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 246 - protein, 529 aa, Homo sapiens
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 247 - DNA, 2315 bp, Homo sapiens
cctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtctcagcgcgggggacgactcagagttggggtctcactgtgttgcccagactggtctcgaactcttggcctcaggtgatcctcttccctcagcttcccagaatgccgagatgatagagacggggtctgactgtgttacccaggctggtcttcaactcttggcctcaagtgatcctcctgccttagcttccaagaatgctgaggttacaggcaccatgagccaggacaccgaggtggatatgaaggaggtggagctgaatgagttagagcccgagaagcagccgatgaacgcggcgtctggggcggccatgtccctggcgggagccgagaagaatggtctggtgaagatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcataatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccaattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctggcgtggatgggttccaggttcgggacatagagaatctgaaggatgcatcctcattcttggctgagtggcaaaatatcaccaagggcttcagtgaagacaggctcttgattgcggggactaactcctccgaccttcagcagatcctgagcctactcgaatccaacaaagacttgctgttgactagctcatacctgtctgattctggttctactggggagcatacaaaatccctagtcacacagtatttgaatgccactggcaatcgctggtgcagctggagtttgtctcaggcaaggctcctgacttccttcttgccggctcaacttctccgactctaccagctgatgctcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagaccctggctccctcctttccttgttccggcggctgagtgaccagcggagtaaggagcgctccctactgcatggggacttccacgcgttctccgctgggcctggactcttctcctatatccgccactgggaccagaatgagcgttttctggtagtgcttaactttggggatgtgggcctctcggctggactgcaggcctccgacctgcctgccagcgccagcctgccagccaaggctgacctcctgctcagcacccagccaggccgtgaggagggctcccctcttgagctggaacgcctgaaactggagcctcacgaagggctgctgctccgcttcccctacgcggcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttccctctgcttctctcaaaaaaaaaaa

SEQ ID NO: 248 - protein, 630 aa, Homo sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 249 - DNA, 1134 bp, Homo sapiens
gttctcatttttctactgctcgtggatttacgcgcacgttggaaccgaagagagctctgttgttgcaatgttcagcccacaagagcttactggtgaaggaatgggacaagacccatctttatgcaaagccagcgttacagtaatgttccagcatctcataatctatcctggggaattcagctgcctcccagggtgaatacaggtattcctgatgacagtctgcctctatcttacagagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacataaaaaaaaaaaaaaaaa

SEQ ID NO: 250 - DNA, 2716 bp, Homo sapiens
attccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 251 - protein, 421 aa, Homo sapiens; identical to SEQ ID NO: 221

SEQ ID NO: 252 - DNA, 2712 bp, Homo sapiens
attccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagactacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 253 - protein, 421 aa, Homo sapiens; identical to SEQ ID NO: 221

SEQ ID NO: 254 - DNA, 2573 bp, Homo sapiens
attccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctac

SEQ ID NO: 255 - protein, 421 aa, Homo sapiens; identical to SEQ ID NO: 221

SEQ ID NO: 256 - DNA, 207 bp, Homo sapiens
tccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagcc

SEQ ID NO: 257 - DNA, 125 bp, Homo sapiens
tcccaatgaagaaactttcacatgtcttactctctgtcctagtcccagagcctgtaaaggtgaaccactgggactggctgggggagaagaggaagatttgttccagaaggaactgtctgagggat

SEQ ID NO: 258 - DNA, 67 bp, Homo sapiens
ttcctatgatgaggaccttttcacagacctgtactgagctccgtgaggataaataactctgaggaga

SEQ ID NO: 259 - DNA, 75 bp, Homo sapiens
ctacggggatgattttacgaactgaactctctctttctgatggattagtggagaaaacagaaaattctgagtagc

SEQ ID NO: 260 - DNA, 72 bp, Homo sapiens
actccatgatgaacacaaaatgacaagcatatggctgaactttcaagtgatgtcatcttactactgagaagt

SEQ ID NO: 261 - DNA, 75 bp, Homo sapiens
gtcagatgatttgaattgataagctgatgttctgtgaggtacaaaagttaatagcatgttagagttctgatggca

SEQ ID NO: 262 - DNA, 65 bp, Homo sapiens
tttctatgatgaatcaaactagctcactatgaccgacagtgaaaatacatgaacacctgagaaac

SEQ ID NO: 263 - DNA, 70 bp, Homo sapiens
gtttgtgatgacttacatggaatctcgttcggctgatgacttgctgttgagactctgaaatctgattttc

SEQ ID NO: 264 - DNA, 68 bp, Homo sapiens
caccagtgatgagttgaataccgccccagtctgatcaatgtgtgactgaaaggtattttctgagctgt

SEQ ID NO: 265 - DNA, 12227 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 266 - protein, 3664 aa, Homo sapiens
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 267 - DNA, 3893 bp, Homo sapiens
gggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagatactacagatcaacaaagatgacgtaactgccctgcattgtaaagtggtatgccttatccagaatggaagtttcaaggaagctttgaatgtcatcaatactcacaccaaagtgttagccaataactctctctcctttgaaaaggcatattgcgagtacaggctgaacagaattgagaatgccttgaagacaatagaaagtgccaaccagcagacagacaaactgaaggagctttatggacaagtgttataccgtttggaacgctatgatgaatgcttagcagtgtatagagatctcgtccgaaactcccaagatgattatgatgaggagaggaaaacaaacctttcagcagttgttgcagctcaaagcaattgggaaaaagtggttccagagaacctgggcctccaagaaggcacacatgagctgtgctacaacactgcatgtgcactgataggccaaggccagctgaaccaggccatgaaaatcctacaaaaagctgaagatctttgccgccgttcattatcagaagacactgatgggactgaggaagacccacaggcagaactggccatcattcatggtcagatggcttatattctgcagcttcagggtcgaacagaggaggctttgcaactttacaatcaaataataaaactaaaaccaacagatgtgggattactagctgtaattgcaaataacatcattaccattaacaaggaccaaaatgtctttgactccaagaagaaagtgaaattaaccaatgcggaaggagtagagtttaagctttccaagaaacaactacaagctatagaatttaacaaagctttacttgctatgtacacaaaccaggctgaacaatgccgcaaaatatctgccagtttacagtcccaaagtcccgagcatctcttacctgtgttaatccaagctgcccagctctgccgtgaaaagcagcacacaaaagcaatagagctgcttcaggaattttcagatcagcatccagaaaatgcagctgaaattaagctgaccatggcacagttgaaaatttctcaaggtaatatttctaaagcatgtctaatattgagaagcatagaggagttaaagcataaaccaggcatggtatctgcattagttaccatgtatagccatgaagaagatattgatagtgccattgaggtcttcacacaagctatccagtggtatcaaaaccatcagccaaaatctcctgctcatttgtccttgataagagaagctgcaaacttcaaactcaaatatgggcggaagaaggaggcaattagtgacctacaacagctgtggaaacaaaatccaaaagatattcacaccctggcacagcttatttctgcttactcacttgtagatccagagaaagccaaagctcttagtaaacacttgccatcgtcagatagtatgtctctaaaagtagatgttgaggctcttgaaaattctgctggtgctacatacattcggaagaagggtggaaaagttactggagatagtcaaccaaaggaacaaggacagggagatttgaaaaagaagaaaaagaaaaagaagggaaaattgcctaagaattatgacccaaaagttaccccagatccagaaagatggctgccaatgcgagaacgttcttactaccggggaagaaagaagggtaaaaagaaggatcagattggaaaagggacccagggagcaactgcaggagcttcatctgaactggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaacaagtatttccttgtgattatattactctgtccttgttaataaagtgctgctgtgtttgactctgaacatactaccaaaacttcttcaaagagttttttatgaaagactttcctcctttacaagaaagaaatggggtgctgcctttctgtttagtaaaagcagaatttgcagtggcatctaaagagatcttttttaaataaaaattatgtattgtggcataatcctttttttgagctctacagagaacagtcttttggtaatagtggcaggtatttattccttctgaatatataccccattataggaataactgttacttatttaggattccatcattgaaaattttgacccaaggcacagcagtgaaatttatagttctcaatttagttgtcattattgacaggcattggtattattagtcattgctaagcaactaaaacttcatcagttcaaataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggaaaaaaaaaaaaaaaaaa

SEQ ID NO: 268 - protein, 671 aa, Homo sapiens
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDDYDEERKTNLSAVVAAQSNWEKVVPENLGLQEGTHELCYNTACALIGQGQLNQAMKILQKAEDLCRRSLSEDTDGTEEDPQAELAIIHGQMAYILQLQGRTEEALQLYNQIIKLKPTDVGLLAVIANNIITINKDQNVFDSKKKVKLTNAEGVEFKLSKKQLQAIEFNKALLAMYTNQAEQCRKISASLQSQSPEHLLPVLIQAAQLCREKQHTKAIELLQEFSDQHPENAAEIKLTMAQLKISQGNISKACLILRSIEELKHKPGMVSALVTMYSHEEDIDSAIEVFTQAIQWYQNHQPKSPAHLSLIREAANFKLKYGRKKEAISDLQQLWKQNPKDIHTLAQLISAYSLVDPEKAKALSKHLPSSDSMSLKVDVEALENSAGATYIRKKGGKVTGDSQPKEQGQGDLKKKKKKKKGKLPKNYDPKVTPDPERWLPMRERSYYRGRKKGKKKDQIGKGTQGATAGASSELDASKTVSSPPTSPRPGSAATVSASTSNIIPPRHQKPAGAPATKKKQQQKKKKGGKGGW

SEQ ID NO: 269 - DNA, 3394 bp, Homo sapiens
ccgcgcgtgtggcagtcgcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaaaaaaaaaaa

SEQ ID NO: 270 - protein, 370 aa, Homo sapiens
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 271 - DNA, 2490 bp, Homo sapiens
actgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaagaaaaaaaaaaaaaaa

SEQ ID NO: 272 - protein, 786 aa, Homo sapiens
MSFSRALLWARLPAGRQAGHRAAICSALRPHFGPFPGVLGQVSVLATASSSASGGSKIPNTSLFVPLTVKPQGPSADGDVGAELTRPLDKNEVKKVLDKFYKRKEIQKLGADYGLDARLFHQAFISFRNYIMQSHSLDVDIHIVLNDICFGAAHADDLFPFFLRHAKQIFPVLDCKDDLRKISDLRIPPNWYPDARAMQRKIIFHSGPTNSGKTYHAIQKYFSAKSGVYCGPLKLLAHEIFEKSNAAGVPCDLVTGEERVTVQPNGKQASHVSCTVEMCSVTTPYEVAVIDEIQMIRDPARGWAWTRALLGLCAEEVHLCGEPAAIDLVMELMYTTGEEVEVRDYKRLTPISVLDHALESLDNLRPGDCIVCFSKNDIYSVSRQIEIRGLESAVIYGSLPPGTKLAQAKKFNDPNDPCKILVATDAIGMGLNLSIRRIIFYSLIKPSINEKGERELEPITTSQALQIAGRAGRFSSRFKEGEVTTMNHEDLSLLKEILKRPVDPIRAAGLHPTAEQIEMFAYHLPDATLSNLIDIFVDFSQVDGQYFVCNMDDFKFSAELIQHIPLSLRVRYVFCTAPINKKQPFVCSSLLQFARQYSRNEPLTFAWLRRYIKWPLLPPKNIKDLMDLEAVHDVLDLYLWLSYRFMDMFPDASLIRDLQKELDGIIQDGVHNITKLIKMSETHKLLNLEGFPSGSQSRLSGTLKSQARRTRGTKALGSKATEPPSPDAGELSLASRLVQQGLLTPDMLKQLEKEWMTQQTEHNKEKTESGTHPKGTRRKKKEPDSD

SEQ ID NO: 273 - DNA, 4611 bp, Homo sapiens
ctgataaagagctgggctgagtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaaaaaaaaaaaaaaaaaaaaaa

SEQ ID NO: 274 - protein, 685 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQVWKPSFCFK

SEQ ID NO: 275 - DNA, 5384 bp, Homo sapiens
ctgataaagagctgggctgagtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcacacacacacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctgtgtcattttc

SEQ ID NO: 276 - protein, 903 aa, Homo sapiens
MEGYSEEASLLRHLEKVASEEEEVPLVVYLKENAALLTANGLHLSQNREAQQSSPAPPPAEVHSPAADVNQNLASPSATLTTPTSNSSHNPPATDVNQNPPATVVPQSLPLSSIQQNSSEAQLPSNGTGPASKPSTLCADGQPQAPAEEVRCSTLLIDKVSTPATTTSTFSREATLIPSSRPPASDFMSSSLLIDIQPNTLVVSADQEMSGRAAATTPTKVYSEVHFTLAKPPSVVNRTARPFGIQAPGGTSQMERSPMLERRHFGEKAPAPQPPSLPDRSPRPQRHIMSRSPMVERRMMGQRSPASERRPLGNFTAPPTYTETLSTAPLASWVRSPPSYSVLYPSSDPKSSHLKGQAVPASKTGILEESMARRGSRKSMFTFVEKPKVTPNPDLLDLVQTADEKRRQRDQGEVGVEEEPFALGAEASNFQQEPAPRDRASPAAAEEVVPEWASCLKSPRIQAKPKPKPNQNLSEASGKGAELYARRQSRMEKYVIESSSHTPELARCPSPTMSLPSSWKYPTNAPGAFRVASRSPARTPPASLYHGYLPENGVLRPEPTKQPPYQLRPSLFVLSPIKEPAKVSPRAASPAKPSSLDLVPNLPKGALPPSPALPRPSRSSPGLYTSPGQDSLQPTAVSPPYGGDISPVSPSRAWSPRAKQAPRPSFSTRNAGIEAQDRRESLPTSPPWTPGASRPPSSLDGWVSPGPWEPGRGSSMSSPPPLPPPPPMSPSWSERSVSPLRPETEARPPSRQLQALLARNIINAARRKSASPRSAGAENPRPFSPPRAPPPPPPPPPPPPRMRSPQPARPGSAAVPGAAFAPIPRSPLPAGPSSCTSPRSPLPAPPRPFLYRRSPTDSDVSLDSEDSGAKSPGILGYNICPRGWNGSLRLKRGSLPAEASCTT

SEQ ID NO: 277 - DNA, 2594 bp, Homo sapiens
agccttcccctggctccatgggtttccccctcccctgttgtatctaccctgccccagctcttccctgcccacccctcgctgactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 278 - protein, 285 aa, Homo sapiens
MDPVSQLASAGTFRVLKEPLAFLRALELLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 279 - DNA, 2632 bp, Homo sapiens
aaagcagtcctgcacttccagttgtgagccaagagccaagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatacaaaaaaaaaaaaaaaaaaaaaaaaaa

SEQ ID NO: 280 - protein, 265 aa, Homo sapiens
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 281 - DNA, 4647 bp, Homo sapiens
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaaaaaaaaaaaaaaaa

SEQ ID NO: 282 - protein, 1085 aa, Homo sapiens
MAAGSDLLDEVFFNSEVDEKVVSDLVGSLESQLAASAAHHHHLAPRTPEVRAAAAGALGNHVVSGSPAGAAGAGPAAPAEGAPGAAPEPPPAGRARPGGGGPQRPGPPSPRRPLVPAGPAPPAAKLRPPPEGSAGSCAPVPAAAAVAAGPEPAPAGPAKPAGPAALAARAGPGPGPGPGPGPGPGPGKPAGPGAAQTLNGSAALLNSHHAAAPAVSLVNNGPAALLPLPKPAAPGTVIQTPPFVGAAAPPAPAAPSPPAAPAPAAPAAAPPPPPPAPATLARPPGHPAGPPTAAPAVPPPAAAQNGGSAGAAPAPAPAAGGPAGVSGQPGPGAAAAAPAPGVKAESPKRVVQAAPPAAQTLAASGPASTAASMVIGPTMQGALPSPAAVPPPAPGTPTGLPKGAAGAVTQSLSRTPTATTSGIRATLTPTVLAPRLPQPPQNPTNIQNFQLPPGMVLVRSENGQLLMIPQQALAQMQAQAHAQPQTTMAPRPATPTSAPPVQISTVQAPGTPIIARQVTPTTIIKQVSQAQTTVQPSATLQRSPGVQPQLVLGGAAQTASLGTATAVQTGTPQRTVPGATTTSSAATETMENVKKCKNFLSTLIKLASSGKQSTETAANVKELVQNLLDGKIEAEDFTSRLYRELNSSPQPYLVPFLKRSLPALRQLTPDSAAFIQQSQQQPPPPTSQATTALTAVVLSSSVQRTAGKTAATVTSALQPPVLSLTQPTQVGVGKQGQPTPLVIQQPPKPGALIRPPQVTLTQTPMVALRQPHNRIMLTTPQQIQLNPLQPVPVVKPAVLPGTKALSAVSAQAAAAQKNKLKEPGGGSFRDDDDINDVASMAGVNLSEESARILATNSELVGTLTRSCKDETFLLQAPLQRRILEIGKKHGITELHPDVVSYVSHATQQRLQNLVEKISETAQQKNFSYKDDDRYEQASDVRAQLKFFEQLDQIEKQRKDEQEREILMRAAKSRSRQEDPEQLRLKQKAKEMQQQELAQMRQRDANLTALAAIGPRKKRKVDCPGPGSGAEGSGPGSVVPGSSGVGTPRQFTRQRITRVNLRDLIFCLENERETSHSLLLYKAFLK

SEQ ID NO: 283 - DNA, 4447 bp, Homo sapiens
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaa

SEQ ID NO: 284 - protein, 955 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEAKEQTFSGGTSQDTKASESSKPWPDATYGTGSASRASAVSELSPRERSPALKSPLQSVVVRRRSPRPSPVPKPSPPLSSTSQMGSTLPSGAGYQSGTHQGQFDHGSGSLSPSKKSPVGKSPPSTGSTYGSSQKEESAASGGAAYTKRYLEEQKTENGKDKEQKQTNTDKEKIKEKGSFSDTGLGDGKMKSDSFAPKTDSEKPFRGSQSPKRYKLRDDFEKKMADFHKEEMDDQDKDKAKGRKESEFDDEPKFMSKVIGANKNQEEEKSGKWEGLVYAPPGKEKQRKTEELEEESFPERSKKEDRGKRSEGGHRGFVPEKNFRVTAYKAVQEKSSSPPPRKTSESRDKLGAKGDFPTGKSSFSITREAQVNVRMDSFDEDLARPSGLLAQERKLCRDLVHSNKKEQEFRSIFQHIQSAQSQRSPSELFAQHIVTIVHHVKEHHFGSSGMTLHERFTKYLKRGTEQEAAKNKKSPEIHRRIDISPSTFRKHGLAHDEMKSPREPGYKAEGKYKDDPVDLRLDIERRKKHKERDLKRGKSRESVDSRDSSHSRERSAEKTEKTHKGSKKQKKHRRARDRSRSSSSSSQSSHSYKAEEYTEETEEREESTTGFDKSRLGTKDFVGPSERGGGRARGTFQFRARGRGWGRGNYSGNNNNNSNNDFQKRNREEEWDPEYTPKSKKYYLHDDREGEGSDKWVSRGRGRGAFPRGRGRFMFRKSSTSPKWAHDKFSGEEGEIEDDESGTENREEKDNIQPTTE

SEQ ID NO: 285 - DNA, 1011 bp, Homo sapiens
ggcacaacagagccgctcccctctcctcgccccgccaccgggacgagaggcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccctattccctgctctgaggaacagtgtgaaaaaaagtcttttaggagatttacaatatctgttcttttgctcatcttagaccacagactgactttgaaattatgttaagtgaaatatcaatgaaaataaagtttactataaataataaaaaaaaaaaaaaaaaaaaaaaaaaaaa

SEQ ID NO: 286 - protein, 112 aa, Homo sapiens
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 287 - DNA, 3687 bp, Homo sapiens
gtttccgggcgggcctccagaggccggcgcacaagatggcggctctggcggcctaaagaaggcggccgcggctcagccgtgggctctaacgcggggctgggggccggagacagacttcgcccaggtgacgggtagtaggggcggcgccgcttggcctcgtggggtgtaagacccacttgctgttgcccccggaccttgccgccacaccagccctgtcctggggcggaaccgaaggaaggtcgggccctgctgccccgccccgtccttcctccttcccgggcggtcactgtgcgtggctcacttttagagtttacttcaaccacgtggagcttccatggcggcctctcaggtcctgggggagaagattaacatcctgtcgggagagactgtcaaagctggggacagggacccgctggggaacgactgtcccgagcaagataggctcccccagcgctcctggaggcagaagtgtgcctcctacgtgttggccctgaggccctggagcttcagtgcctcactcacaccggtggccctgggcagtgcccttgcctacagatcccacggtgtcctggatcccaggctcttggtgggttgtgccgtggctgtcctggctgtgcacggggccggtaatttggtcaacacttactatgacttttccaagggcattgaccacaaaaagagtgatgacaggacacttgtggaccgaatcttggagccgcaggatgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgccatccaggtggggtccctggccatcttcccactggtctatgccatccccctcgccctcagcaccgaggccattctccattccaacaacaccagggacatggagtccgaccgggaggctggtatcgtcacgctggccatcctcatcggccccacgttctcctacattctctacaacacactgctcttcctgccctacctggtcttcagcatcctggccacacactgcaccatcagcctggcactccccctgcttaccattcccatggccttctcccttgagagacagtttcgaagccaggccttcaacaaactgccccagaggactgccaagctcaacctcctgctgggacttttctatgtctttggcatcattctggcaccagcaggcagtctgcccaaaatttaaggggacaagtagctccccccacgacatgtctccctttcttagaatatattaaagtcagagtctctgaggaaggaatgtgatttggcagtcagggtactaagcatgggtgggaactcctgccttataaaaattgtttttgtgttcttaaagataatatgttgtttttctgttttttgttttttccattttatggggaatttaaaaaccattcttgtatcagaaggtgaattaggcgcatggtctttgttttattaataatttccactagagggtgttctcaggtcactttgcagtgaagtggacttagttcctccttgttctgtacaaaatgtctccagactttgtaaaggagctgcccagtttggcctcctgtcccgaaaagaccctaataactaggcagagtgttgtcctgctttcttcgtctcgtaggatgtgctatgattggtgccaggcctcactaacacaggggctacctgtctcttattctcagcacctgtgtcctgagatacgctgcctgagacagagagagtccctcattaacagcctgtgtggctgtcagctttttgcctaaattgtgattcagatgcttttgttctctctcctttcacttattgccacagttgaggaaaagtgtcagattaccctgcagcaagacaagccaaggactgggagggaaaaaaaaaccactctggaggcaactgagaaaatcactgcttttggataggaatcagtagggtggctgttttccctttgttgaatctactagagtgacaggaaggactcccagccctttcagtaactatcaggagccctgaaacggtagaggcactgccatccttgtgggatactcaaagcccacagggcttttccctccctattgcatcttctgatgctccccacacctaccctccacctctccacctctgtggtgttcccatttgtgtgtttcccatctgtggagccagactgagcaatagcttagcagcgagtcagggacagctgccactttccacagagccacaggatgggcagagcagggacccagggaatgaatagccagtggacaaacagtcttgagctctgttcagccagagtgatgggccctgccagttaaggggctgtgtcttcatccttgaagacagatgtgcaatattgaccctgcctctccccagggctttgtggaaagatagttgagggctttagtgagatcacactcagagtggggcaattccagcatttatcctggctgcgtttcattgcattgtctgtgaagtataatttctgggccagaattgctcagttgcatttgatccaggactatagattggaaatgggtcatcattgttttctgttgtgattatagccattctagtaggcgtttaaggtcatggcctgcagaaaatgatgtaagaactagttcttaatctttcagatcaagctaatgatgatatggaaccttgagttcgaattgattggtttacttggaaaaaaacatgtttgaaaattgcaaaagttccgccgggcgcggtggctcatgcctgtaatcccagcactttgggaggccgagacgggcggatcacgaggtcaggagatcgagaccatcttggctaacacggtgaaaccccgtttctactaaaaatacaaaaaattagccaggcgtgttggcgggcgcctgtagtcccagctacctgggcggctgaggcaggagcatggcgtgaacccaggaggcggagcttgcagtgagctgagatcatgccactgcactccaacctgggggacacagcaagactccgtctcaaaaaaaaaaaaagaaaaagaaaattgcaaaagttcctctaaagttaaatcaaaggtggtttgtctagcagagagccagaatcttctaatagtgggcagagcccagagacaaggggaagaaagatgaccttctccccagtccttcccagcaccatttttgtttcacaccaggcttgtggcattttggtgctcacaggggttttgccttctgacctctccttggagtaggccattctcatgcagggctcaccctgaggcaggaggaccaagggctccctgcgtccacggaccacgtatgccttggtggtcactcccatcggggctatcagttctgcactgtgccctggtgcggattttaatgcatatttttatatataaatgttcccaaaggccaaatttgttgccaggttttatacgcaggtcaccataatttgtattatgttccctgagtcaatgaaggttttctttagacttcttaattaaaaagagaagaaagaaaatgttcaaaaaaaaaaaaaaaaaaaaaaaaaaaaaaaaaa

SEQ ID NO: 288 - protein, 338 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQVGSLAIFPLVYAIPLALSTEAILHSNNTRDMESDREAGIVTLAILIGPTFSYILYNTLLFLPYLVFSILATHCTISLALPLLTIPMAFSLERQFRSQAFNKLPQRTAKLNLLLGLFYVFGIILAPAGSLPKI

SEQ ID NO: 289 - DNA, 2628 bp, Homo sapiens
gtgcgctgccgtaccggtcacgtggacgtttggtcacgtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaaatgttcacacttaaaggaaatcgtttgccggcagctgatgtgaagaatataattttttttgtcagacccaggctagagttgatggatataatcgctgaaaacgtgctcagtgaagatagacgaggcccaacgagagattttcatattctgtttgtgccacgccgtagcctgttgtgcgaacagcggttgaaggatctgggtgtcttgggatcctttattcacagggaggagtacagcttagatctcattccattcgatggggatctcttatccatggaatcagagggtgcattcaaagagtgctacctggagggtgaccagacgagcctgtaccacgcagccaaggggctgatgaccctgcaagctctgtatggaacgatcccccagatctttgggaaaggagaatgcgctcggcaagtggccaatatgatgatcaggatgaagagagagtttacaggaagccagaattcaatatttcctgtttttgataatctcttgttgcttgatcggaatgtggatttattaacacctcttgccactcagctgacatatgaaggactcattgatgaaatttatggcattcagaacagttatgtgaaattacctccagagaaatttgcacctaagaaacagggcgatggtggtaaggacctccccacggaagcaaagaagctgcagctgaattctgcagaggagctctatgctgagatccgagataagaacttcaacgcagttggctctgtgctcagcaagaaagcaaagatcatctctgcagcattcgaggaaagacacaatgctaagaccgtgggggagatcaagcagtttgtttcccagttgccccacatgcaggcagcaaggggctcgcttgcaaaccatacctcaattgcagaattgatcaaagatgtcactacttctgaagacttttttgataaattaaccgtggaacaggagtttatgtctggaatagacactgataaggtcaacaattacattgaggattgtatcgcccaaaagcactcgttgatcaaggtgttaagactagtttgcctccaatccgtgtgtaatagtgggctcaaacaaaaagttttggattattacaaaagagagattctccagacatacggctatgagcacatattgaccttacacaacctggagaaggccggcctgctgaaaccgcagacggggggcagaaacaattacccaactatacggaaaacattacgcctctggatggatgatgttaatgagcaaaaccccacggacatatcgtatgtgtacagtgggtatgccccgctcagtgtgcggctggcccagctgctttcccggcctggctggcggagcatcgaggaggtcctccgcatcctcccagggccccactttgaggagcggcagccactgcccacaggactgcagaagaaacgtcaaccgggagaaaaccgagtgactctgatatttttccttgggggcgtaaccttcgctgaaattgctgccctgcgatttctctcccagttggaagatggaggtacagaatatgtcattgccaccactaaactaatgaatggaaccagttggatagaggctctgatggaaaaacctttctaggatgttcagaggagacttaacaagtgtactgcagaataaactacctctttgaagaaattgctgaaaggaagtaaaaccccatagaagaaacatgggaatacagaatatattctggggtcagcttcttaaattatactactgtttactgctttctccgtctcttttgtattccctttttttttttcctttgagacggagtcttgctctgtcacccagactagagtgcagtggcacggtctcacctcactgcaacctccacctcctaggttcaagcaattctcctgcctcagcctcctgagtagctgggactacaggcatgcaccaccacacccggctaatttttgtatttttagtagccatggtgtttcaccatgttggccaggctggtctcaaactcctgacctcaggtgatccacctgcctcggcctcccacagtgctgggattacaggcctgagccaccgtgcctggcccctaatctgctgaagaaagaagaatagaagaaaatcaacctgagtaaaagcagcactggttttgagttttctaagctcagggtcttcattagagacctctggaaatacattaaggatggtgggggtagataatccattcagccagacaaacggggccagctcttaaaataagaaagctgagactgaggaggtgaaactgaaaataaaaagagaaagttcatcctctaaaaaaaaaaaaaaaaaaaaaaaaaaa

SEQ ID NO: 290 - protein, 596 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYEGLIDEIYGIQNSYVKLPPEKFAPKKQGDGGKDLPTEAKKLQLNSAEELYAEIRDKNFNAVGSVLSKKAKIISAAFEERHNAKTVGEIKQFVSQLPHMQAARGSLANHTSIAELIKDVTTSEDFFDKLTVEQEFMSGIDTDKVNNYIEDCIAQKHSLIKVLRLVCLQSVCNSGLKQKVLDYYKREILQTYGYEHILTLHNLEKAGLLKPQTGGRNNYPTIRKTLRLWMDDVNEQNPTDISYVYSGYAPLSVRLAQLLSRPGWRSIEEVLRILPGPHFEERQPLPTGLQKKRQPGENRVTLIFFLGGVTFAEIAALRFLSQLEDGGTEYVIATTKLMNGTSWIEALMEKPF

SEQ ID NO: 291 - DNA, 3003 bp, Homo sapiens
ctttctccttccccttcttccgggctcccgtcccggctcatcacccggcctgtggcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 292 - protein, 245 aa, Homo sapiens
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 293 - DNA, 3077 bp, Homo sapiens
gcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 294 - protein, 245 aa, Homo sapiens; identical to SEQ ID NO: 292

SEQ ID NO: 295 - DNA, 2121 bp, Homo sapiens
gatcgggtaggcggctctttgtcgaagctagaggaccggcaggcggcagcagcaactacggcggcggcggcagaacccagcagcgatgtggaggtggagacccacaggagccccggacttcacctgagctacctcagtggtcaccaagagtggcaagataaagaaaaccctgagttgggcgggaccaggatgcctgaccgggacagctatgccaacggtaccgggagcagcggtggaggccctggaggtggtggcagcgaggaggccagtggggcaggggtaggcagtggcggggccagctcagatgccatctgtagagacttcttgaggaatgtgtgcaagcgaggcaagcgttgccgatatcgccacccagacatgagcgaggtgtccaacttgggggtgagcaaaaacgagttcatcttctgccatgacttccagaacaaggagtgtagccgcccaaattgccgtttcatccatggctccaaggaggatgaggatggctataagaagacaggagagcttcccccacggctgaggcagaaagtagcagctggccttggcctttcaccggctgacctaccaaatggcaaggaggaggtccctatctgccgtgactttctcaagggtgactgtcagagaggagccaagtgcaagttccgtcacctgcaacgggattttgagtttgatgctcggggtggaggaggcactggtgggggctcaacaggctcagtcctcccaggacgacgtcatgatctctatgatatctatgaccttcctgacaggggctttgaggaccatgagccaggcccaaaacgccggcgaggtggatgctgcccccctgatggccctcattttgagtcatatgaatatagtttggctccaccgcgaggggtggagtgcagactgctagaggaggagaatgccatgctcaggaagcgggtagaggagttaaagaagcaggtcagcaacctgctggccaccaatgaggtactactggaacaaaatgctcagttccgcaatcaggccaaggtcataaccctgagctccactgcaccagcgactgagcagactctggcccccactgtgggcactgttgccacttttaaccatggcattgcccagactcacactactctcagcagccaggctctacagcctcgtccagtgtcccagcaagaactggtggcccctgctggagctccagctgctcccccaactaatgctgcacctcctgctgctccgccacccccacccccacacttgaccccagagatcacgccactgtcagctgccctggctcaaacaattgcccagggaatggcacctccacctgtctccatggctcctgtggctgtatctgtggctcctgtggcccctgtggctgtatcgatggcccaacccttggcaggaatcacaatgagccacaccaccactcccatggtgacttaccctatcgcttcccagagcatgcgcatcacggccatgccacactgatggggctaatggacactcccctggtatagcctcgcagggctggggtcagggggcccttgcccactcacctagccttccccatccctgtctgaagggctcccttgagaactaggacaagagactacaaggagtatgtcctgaggaggggttgggatggtgtgttttctctcacctcccttttatgagggtcctcttgtccatcttcaagcctcacagtgggggcttgcagaggagtgcagactgaagccagcagagaggaaggactgactgaggggctgtgtcctcttatgggaatttgggaacatccctcgtcttgtcctctcttctgcacagcacaggttccagcactggttttagaagaaaaaaataccctgcccagagggaaagccaggaaagattgggaagtgggtggtcaggagagaaggcctgataggagccttcagacaatttgggtcctagttgcttgggttggacaatacaggaattgcttctgggccctgggaaagctgggaccatagtgctccagcccaaagactaggggagcattcattaccctagtttgacctgaaaatccatagggcagggcccactactttccaaagaaataaaagaacaattatttttaac

SEQ ID NO: 296 - protein, 434 aa, Homo sapiens
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 297 - DNA, 5811 bp, Homo sapiens
gtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggatta

SEQ ID NO: 298 - protein, 805 aa, Homo sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 299 - DNA, 1249 bp, Homo sapiens
cgcgaaaagccgggactggacctcgcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtacaaaaaaaaaaaaaaaaaaaaaaaaaaaaaa

SEQ ID NO: 300 - protein, 208 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPEMHLQRRLMSFFQ

SEQ ID NO: 301 - DNA, 1535 bp, Homo sapiens
cgcgaaaagccgggactggacctcgcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagcatggaaagtacaaaaaaaaaaaaaaaaaaaaaaaaaaaaaa

SEQ ID NO: 302 - protein, 382 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEVWIFIPKLLFRLTVIILTFKCYYVLFHLHNARVLDV

SEQ ID NO: 303 - DNA, 20 bp, Artificial Sequence
  Synthetic construct
ctccacctcttcttcctccc

SEQ ID NO: 304 - DNA, 19 bp, Artificial Sequence
  Synthetic construct
tccacctcttcttcctccc

SEQ ID NO: 305 - DNA, 20 bp, Artificial Sequence
  Synthetic construct
cctccacctcttcttcctcc

SEQ ID NO: 306 - DNA, 21 bp, Artificial Sequence
  Synthetic construct
acctccacctcttcttcctcc

SEQ ID NO: 307 - DNA, 20 bp, Artificial Sequence
  Synthetic construct
tccacctcttcttcctcccg

SEQ ID NO: 308 - DNA, 21 bp, Artificial Sequence
  Synthetic construct
cacctccacctcttcttcctc

SEQ ID NO: 309 - DNA, 20 bp, Artificial Sequence
  Synthetic construct
acctccacctcttcttcctc

SEQ ID NO: 310 - DNA, 21 bp, Artificial Sequence
  Synthetic construct
tccacctcttcttcctcccga

SEQ ID NO: 311 - DNA, 20 bp, Artificial Sequence
  Synthetic construct
ccacctcttcttcctcccga

SEQ ID NO: 312 - DNA, 19 bp, Artificial Sequence
  Synthetic construct
ctccacctcttcttcctcc

SEQ ID NO: 313 - DNA, 20 bp, Artificial Sequence
  Synthetic construct
tccacctaccactcccagca

SEQ ID NO: 314 - DNA, 21 bp, Artificial Sequence
  Synthetic construct
gttcgtctccttctctctccc

SEQ ID NO: 315 - DNA, 19 bp, Artificial Sequence
  Synthetic construct
gtctccttctctctccctg

SEQ ID NO: 316 - DNA, 20 bp, Artificial Sequence
  Synthetic construct
tcgtctccttctctctccct

SEQ ID NO: 317 - DNA, 20 bp, Artificial Sequence
  Synthetic construct
tccttcttgtctcctccctt

SEQ ID NO: 318 - DNA, 20 bp, Artificial Sequence
  Synthetic construct
ttccttcttgtctcctccct

SEQ ID NO: 319 - DNA, 20 bp, Artificial Sequence
  Synthetic construct
tgtccacctaccactcccag

SEQ ID NO: 320 - DNA, 21 bp, Artificial Sequence
  Synthetic construct
gtgccactctgtctcctttgc

SEQ ID NO: 321 - DNA, 21 bp, Artificial Sequence
  Synthetic construct
tctccttctctctccctggct

SEQ ID NO: 322 - DNA, 21 bp, Artificial Sequence
  Synthetic construct
ttcgtctccttctctctccct

SEQ ID NO: 323 - DNA, 21 bp, Artificial Sequence
  Synthetic construct
gccacttcattgtccgtccct

SEQ ID NO: 324 - DNA, 20 bp, Artificial Sequence
  Synthetic construct
gccacttcattgtccgtccc

SEQ ID NO: 325 - DNA, 19 bp, Artificial Sequence
  Synthetic construct
ctgcctctgtctccctttg

SEQ ID NO: 326 - DNA, 20 bp, Artificial Sequence
  Synthetic construct
gctgcctctgtctccctttg

SEQ ID NO: 327 - DNA, 19 bp, Artificial Sequence
  Synthetic construct
gctgcctctgtctcccttt

SEQ ID NO: 328 - DNA, 20 bp, Artificial Sequence
  Synthetic construct
ctgcctctgtctccctttgg

SEQ ID NO: 329 - DNA, 21 bp, Artificial Sequence
  Synthetic construct
ccacttcattgtccgtccctc

SEQ ID NO: 330 - DNA, 20 bp, Artificial Sequence
  Synthetic construct
ccctgagtccacttgtccct

SEQ ID NO: 331 - DNA, 21 bp, Artificial Sequence
  Synthetic construct
gccaatctctcccttgtaccc

SEQ ID NO: 332 - DNA, 21 bp, Artificial Sequence
  Synthetic construct
gctctcccttggctcctttct

SEQ ID NO: 333 - DNA, 21 bp, Artificial Sequence
  Synthetic construct
tcctcacttccctcatcctcc

SEQ ID NO: 334 - DNA, 20 bp, Artificial Sequence
  Synthetic construct
cctcacttccctcatcctcc

SEQ ID NO: 335 - DNA, 21 bp, Artificial Sequence
  Synthetic construct
cctcacttccctcatcctcca

SEQ ID NO: 336 - DNA, 21 bp, Artificial Sequence
  Synthetic construct
ctcctcacttccctcatcctc

SEQ ID NO: 337 - DNA, 21 bp, Artificial Sequence
  Synthetic construct
gctcctcacttccctcatcct

SEQ ID NO: 338 - DNA, 20 bp, Artificial Sequence
  Synthetic construct
ctcctcacttccctcatcct

SEQ ID NO: 339 - DNA, 20 bp, Artificial Sequence
  Synthetic construct
tcctcacttccctcatcctc

SEQ ID NO: 340 - DNA, 21 bp, Artificial Sequence
  Synthetic construct
cttccctcatcctccatctct

SEQ ID NO: 341 - DNA, 20 bp, Artificial Sequence
  Synthetic construct
gctcctcacttccctcatcc

SEQ ID NO: 342 - DNA, 20 bp, Artificial Sequence
  Synthetic construct
ctcacttccctcatcctcca

SEQ ID NO: 343 - DNA, 20 bp, Artificial Sequence
  Synthetic construct
gtcactcaccctccagacct

SEQ ID NO: 344 - DNA, 20 bp, Artificial Sequence
  Synthetic construct
tcactcaccctccagacctt

SEQ ID NO: 345 - DNA, 21 bp, Artificial Sequence
  Synthetic construct
gtcactcaccctccagacctt

SEQ ID NO: 346 - DNA, 19 bp, Artificial Sequence
  Synthetic construct
tcactcaccctccagacct

SEQ ID NO: 347 - DNA, 21 bp, Artificial Sequence
  Synthetic construct
tcactcaccctccagaccttt

SEQ ID NO: 348 - DNA, 20 bp, Artificial Sequence
  Synthetic construct
ccaccatggctccctcctta

SEQ ID NO: 349 - DNA, 20 bp, Artificial Sequence
  Synthetic construct
ggtatctctgttggcttccc

SEQ ID NO: 350 - DNA, 20 bp, Artificial Sequence
  Synthetic construct
cactcaccctccagaccttt

SEQ ID NO: 351 - DNA, 21 bp, Artificial Sequence
  Synthetic construct
aggtatctctgttggcttccc

SEQ ID NO: 352 - DNA, 19 bp, Artificial Sequence
  Synthetic construct
cactcaccctccagacctt

SEQ ID NO: 353 - DNA, 21 bp, Artificial Sequence
  Synthetic construct
ccaccctttacctctctgcca

SEQ ID NO: 354 - DNA, 20 bp, Artificial Sequence
  Synthetic construct
ccaccctttacctctctgcc

SEQ ID NO: 355 - DNA, 20 bp, Artificial Sequence
  Synthetic construct
cccaccctttacctctctgc

SEQ ID NO: 356 - DNA, 19 bp, Artificial Sequence
  Synthetic construct
cccaccctttacctctctg

SEQ ID NO: 357 - DNA, 19 bp, Artificial Sequence
  Synthetic construct
ccaccctttacctctctgc

SEQ ID NO: 358 - DNA, 20 bp, Artificial Sequence
  Synthetic construct
gccatgtatgttccgttccc

SEQ ID NO: 359 - DNA, 20 bp, Artificial Sequence
  Synthetic construct
caccctttacctctctgcca

SEQ ID NO: 360 - DNA, 19 bp, Artificial Sequence
  Synthetic construct
accctttacctctctgcca

SEQ ID NO: 361 - DNA, 19 bp, Artificial Sequence
  Synthetic construct
caccctttacctctctgcc

SEQ ID NO: 362 - DNA, 20 bp, Artificial Sequence
  Synthetic construct
ccctttacctctctgccagt

SEQ ID NO: 363 - DNA, 20 bp, Artificial Sequence
  Synthetic construct
ccctgcttctctgtcttccc

SEQ ID NO: 364 - DNA, 20 bp, Artificial Sequence
  Synthetic construct
tccctgccacccatcaacca

SEQ ID NO: 365 - DNA, 19 bp, Artificial Sequence
  Synthetic construct
agtccctgccacccatcaa

SEQ ID NO: 366 - DNA, 21 bp, Artificial Sequence
  Synthetic construct
accctgcttctctgtcttccc

SEQ ID NO: 367 - DNA, 21 bp, Artificial Sequence
  Synthetic construct
gtcagcgtgtttcccttccct

SEQ ID NO: 368 - DNA, 21 bp, Artificial Sequence
  Synthetic construct
gcttctttgtcatcctcccac

SEQ ID NO: 369 - DNA, 20 bp, Artificial Sequence
  Synthetic construct
gtcagcgtgtttcccttccc

SEQ ID NO: 370 - DNA, 20 bp, Artificial Sequence
  Synthetic construct
cagtccctgccacccatcaa

SEQ ID NO: 371 - DNA, 19 bp, Artificial Sequence
  Synthetic construct
cctgcttctctgtcttccc

SEQ ID NO: 372 - DNA, 20 bp, Artificial Sequence
  Synthetic construct
agtccctgccacccatcaac

SEQ ID NO: 373 - DNA, 20 bp, Artificial Sequence
  Synthetic construct
ccttcttcccattctccacc

SEQ ID NO: 374 - DNA, 21 bp, Artificial Sequence
  Synthetic construct
ccttcttcccattctccacca

SEQ ID NO: 375 - DNA, 21 bp, Artificial Sequence
  Synthetic construct
accttcttcccattctccacc

SEQ ID NO: 376 - DNA, 20 bp, Artificial Sequence
  Synthetic construct
ctctgccatgtcctccacct

SEQ ID NO: 377 - DNA, 21 bp, Artificial Sequence
  Synthetic construct
ctctgccatgtcctccacctt

SEQ ID NO: 378 - DNA, 21 bp, Artificial Sequence
  Synthetic construct
caccttcttcccattctccac

SEQ ID NO: 379 - DNA, 20 bp, Artificial Sequence
  Synthetic construct
cttcttcccattctccacca

SEQ ID NO: 380 - DNA, 20 bp, Artificial Sequence
  Synthetic construct
tcttcgcccacctcctcctt

SEQ ID NO: 381 - DNA, 20 bp, Artificial Sequence
  Synthetic construct
accttcttcccattctccac

SEQ ID NO: 382 - DNA, 20 bp, Artificial Sequence
  Synthetic construct
tcttcccattctccaccagc

SEQ ID NO: 383 - DNA, 21 bp, Artificial Sequence
  Synthetic construct
cctcttcctcttcactctcct

SEQ ID NO: 384 - DNA, 20 bp, Artificial Sequence
  Synthetic construct
cctcttcctcttcactctcc

SEQ ID NO: 385 - DNA, 21 bp, Artificial Sequence
  Synthetic construct
acctcttcctcttcactctcc

SEQ ID NO: 386 - DNA, 21 bp, Artificial Sequence
  Synthetic construct
ctcttcctcttcactctcctc

SEQ ID NO: 387 - DNA, 21 bp, Artificial Sequence
  Synthetic construct
tcttcctcttcactctcctct

SEQ ID NO: 388 - DNA, 20 bp, Artificial Sequence
  Synthetic construct
cttcctcttcactctcctct

SEQ ID NO: 389 - DNA, 20 bp, Artificial Sequence
  Synthetic construct
ctcttcctcttcactctcct

SEQ ID NO: 390 - DNA, 20 bp, Artificial Sequence
  Synthetic construct
tcttcctcttcactctcctc

SEQ ID NO: 391 - DNA, 21 bp, Artificial Sequence
  Synthetic construct
cttcctcttcactctcctctt

SEQ ID NO: 392 - DNA, 20 bp, Artificial Sequence
  Synthetic construct
acctcttcctcttcactctc

SEQ ID NO: 393 - DNA, 20 bp, Artificial Sequence
  Synthetic construct
gtcaccttgccaccctctgt

SEQ ID NO: 394 - DNA, 21 bp, Artificial Sequence
  Synthetic construct
tcagtcaccttgccaccctct

SEQ ID NO: 395 - DNA, 20 bp, Artificial Sequence
  Synthetic construct
gtcagtcaccttgccaccct

SEQ ID NO: 396 - DNA, 20 bp, Artificial Sequence
  Synthetic construct
cagtcaccttgccaccctct

SEQ ID NO: 397 - DNA, 21 bp, Artificial Sequence
  Synthetic construct
agtcaccttgccaccctctgt

SEQ ID NO: 398 - DNA, 20 bp, Artificial Sequence
  Synthetic construct
agtcaccttgccaccctctg

SEQ ID NO: 399 - DNA, 20 bp, Artificial Sequence
  Synthetic construct
gatccacagcccagttccca

SEQ ID NO: 400 - DNA, 21 bp, Artificial Sequence
  Synthetic construct
gtctctttcctcctgccttcc

SEQ ID NO: 401 - DNA, 19 bp, Artificial Sequence
  Synthetic construct
agtcaccttgccaccctct

SEQ ID NO: 402 - DNA, 20 bp, Artificial Sequence
  Synthetic construct
tcagtcaccttgccaccctc

SEQ ID NO: 403 - DNA, 20 bp, Artificial Sequence
  Synthetic construct
tccactcctccctctcgtct

SEQ ID NO: 404 - DNA, 21 bp, Artificial Sequence
  Synthetic construct
atccactcctccctctcgtct

SEQ ID NO: 405 - DNA, 20 bp, Artificial Sequence
  Synthetic construct
atccactcctccctctcgtc

SEQ ID NO: 406 - DNA, 20 bp, Artificial Sequence
  Synthetic construct
catccactcctccctctcgt

SEQ ID NO: 407 - DNA, 19 bp, Artificial Sequence
  Synthetic construct
atccactcctccctctcgt

SEQ ID NO: 408 - DNA, 20 bp, Artificial Sequence
  Synthetic construct
tcttcccacctcacctcagc

SEQ ID NO: 409 - DNA, 20 bp, Artificial Sequence
  Synthetic construct
tcccacctcacctcagcctt

SEQ ID NO: 410 - DNA, 20 bp, Artificial Sequence
  Synthetic construct
ttcccacctcacctcagcct

SEQ ID NO: 411 - DNA, 21 bp, Artificial Sequence
  Synthetic construct
ttcccacctcacctcagcctt

SEQ ID NO: 412 - DNA, 21 bp, Artificial Sequence
  Synthetic construct
atcttcccacctcacctcagc

SEQ ID NO: 413 - DNA, 20 bp, Artificial Sequence
  Synthetic construct
ctccctccagtgctctcaga

SEQ ID NO: 414 - DNA, 20 bp, Artificial Sequence
  Synthetic construct
tgctccctccagtgctctca

SEQ ID NO: 415 - DNA, 19 bp, Artificial Sequence
  Synthetic construct
tccctccagtgctctcaga

SEQ ID NO: 416 - DNA, 21 bp, Artificial Sequence
  Synthetic construct
gccagcttgaagagactccca

SEQ ID NO: 417 - DNA, 21 bp, Artificial Sequence
  Synthetic construct
cctcctcttccaaccttcgct

SEQ ID NO: 418 - DNA, 20 bp, Artificial Sequence
  Synthetic construct
gccagcttgaagagactccc

SEQ ID NO: 419 - DNA, 21 bp, Artificial Sequence
  Synthetic construct
tctagattcgctgctccctcc

SEQ ID NO: 420 - DNA, 21 bp, Artificial Sequence
  Synthetic construct
ctccctccagtgctctcagaa

SEQ ID NO: 421 - DNA, 20 bp, Artificial Sequence
  Synthetic construct
cctcctcttccaaccttcgc

SEQ ID NO: 422 - DNA, 20 bp, Artificial Sequence
  Synthetic construct
gcctcctcttccaaccttcg

SEQ ID NO: 423 - DNA, 20 bp, Artificial Sequence
  Synthetic construct
gtccttctcgccctccttct

SEQ ID NO: 424 - DNA, 20 bp, Artificial Sequence
  Synthetic construct
cttctcgccctccttctcct

SEQ ID NO: 425 - DNA, 20 bp, Artificial Sequence
  Synthetic construct
ttctcgccctccttctcctc

SEQ ID NO: 426 - DNA, 20 bp, Artificial Sequence
  Synthetic construct
tccttctcgccctccttctc

SEQ ID NO: 427 - DNA, 20 bp, Artificial Sequence
  Synthetic construct
cgcatcactcccaactccca

SEQ ID NO: 428 - DNA, 20 bp, Artificial Sequence
  Synthetic construct
gtggtgtgttggtgtctgtg

SEQ ID NO: 429 - DNA, 21 bp, Artificial Sequence
  Synthetic construct
acgcatcactcccaactccca

SEQ ID NO: 430 - DNA, 20 bp, Artificial Sequence
  Synthetic construct
acgcatcactcccaactccc

SEQ ID NO: 431 - DNA, 20 bp, Artificial Sequence
  Synthetic construct
gcatcactcccaactcccat

SEQ ID NO: 432 - DNA, 19 bp, Artificial Sequence
  Synthetic construct
gcatcactcccaactccca

SEQ ID NO: 433 - DNA, 21 bp, Artificial Sequence
  Synthetic construct
ccctccctcatcttcctcttc

SEQ ID NO: 434 - DNA, 20 bp, Artificial Sequence
  Synthetic construct
ccctccctcatcttcctctt

SEQ ID NO: 435 - DNA, 19 bp, Artificial Sequence
  Synthetic construct
ccctccctcatcttcctct

SEQ ID NO: 436 - DNA, 21 bp, Artificial Sequence
  Synthetic construct
cctccctcatcttcctcttct

SEQ ID NO: 437 - DNA, 20 bp, Artificial Sequence
  Synthetic construct
cctccctcatcttcctcttc

SEQ ID NO: 438 - DNA, 20 bp, Artificial Sequence
  Synthetic construct
ctccctcatcttcctcttct

SEQ ID NO: 439 - DNA, 19 bp, Artificial Sequence
  Synthetic construct
cctccctcatcttcctctt

SEQ ID NO: 440 - DNA, 21 bp, Artificial Sequence
  Synthetic construct
ctccctcatcttcctcttctt

SEQ ID NO: 441 - DNA, 21 bp, Artificial Sequence
  Synthetic construct
gttcttctgcccacttcctct

SEQ ID NO: 442 - DNA, 19 bp, Artificial Sequence
  Synthetic construct
ctccctcatcttcctcttc

SEQ ID NO: 443 - DNA, 20 bp, Artificial Sequence
  Synthetic construct
accacagcaccctactctcc

SEQ ID NO: 444 - DNA, 20 bp, Artificial Sequence
  Synthetic construct
ctcctctgacgcacttccct

SEQ ID NO: 445 - DNA, 20 bp, Artificial Sequence
  Synthetic construct
tcctctgacgcacttccctg

SEQ ID NO: 446 - DNA, 19 bp, Artificial Sequence
  Synthetic construct
tcctctgacgcacttccct

SEQ ID NO: 447 - DNA, 20 bp, Artificial Sequence
  Synthetic construct
ccgtctccacaatcccactg

SEQ ID NO: 448 - DNA, 21 bp, Artificial Sequence
  Synthetic construct
caccgtctccacaatcccact

SEQ ID NO: 449 - DNA, 19 bp, Artificial Sequence
  Synthetic construct
ccgtctccacaatcccact

SEQ ID NO: 450 - DNA, 19 bp, Artificial Sequence
  Synthetic construct
accacagcaccctactctc

SEQ ID NO: 451 - DNA, 20 bp, Artificial Sequence
  Synthetic construct
accgtctccacaatcccact

SEQ ID NO: 452 - DNA, 20 bp, Artificial Sequence
  Synthetic construct
caccgtctccacaatcccac

SEQ ID NO: 453 - DNA, 20 bp, Artificial Sequence
  Synthetic construct
ctcccagcctccactcaact

SEQ ID NO: 454 - DNA, 21 bp, Artificial Sequence
  Synthetic construct
actcccagcctccactcaact

SEQ ID NO: 455 - DNA, 20 bp, Artificial Sequence
  Synthetic construct
actcccagcctccactcaac

SEQ ID NO: 456 - DNA, 21 bp, Artificial Sequence
  Synthetic construct
ctcccagcctccactcaacta

SEQ ID NO: 457 - DNA, 19 bp, Artificial Sequence
  Synthetic construct
tcccagcctccactcaact

SEQ ID NO: 458 - DNA, 19 bp, Artificial Sequence
  Synthetic construct
actcccagcctccactcaa

SEQ ID NO: 459 - DNA, 19 bp, Artificial Sequence
  Synthetic construct
aactcccagcctccactca

SEQ ID NO: 460 - DNA, 21 bp, Artificial Sequence
  Synthetic construct
tcccagcctccactcaactac

SEQ ID NO: 461 - DNA, 21 bp, Artificial Sequence
  Synthetic construct
tcttcttctgtccacttccct

SEQ ID NO: 462 - DNA, 20 bp, Artificial Sequence
  Synthetic construct
tcccagcctccactcaacta

SEQ ID NO: 463 - DNA, 21 bp, Artificial Sequence
  Synthetic construct
gcattcccaccttccactcct

SEQ ID NO: 464 - DNA, 20 bp, Artificial Sequence
  Synthetic construct
cattcccaccttccactcct

SEQ ID NO: 465 - DNA, 20 bp, Artificial Sequence
  Synthetic construct
gcattcccaccttccactcc

SEQ ID NO: 466 - DNA, 21 bp, Artificial Sequence
  Synthetic construct
cattcccaccttccactccta

SEQ ID NO: 467 - DNA, 19 bp, Artificial Sequence
  Synthetic construct
ttcccaccttccactccta

SEQ ID NO: 468 - DNA, 19 bp, Artificial Sequence
  Synthetic construct
attcccaccttccactcct

SEQ ID NO: 469 - DNA, 19 bp, Artificial Sequence
  Synthetic construct
cattcccaccttccactcc

SEQ ID NO: 470 - DNA, 20 bp, Artificial Sequence
  Synthetic construct
ttcccaccttccactcctat

SEQ ID NO: 471 - DNA, 20 bp, Artificial Sequence
  Synthetic construct
attcccaccttccactccta

SEQ ID NO: 472 - DNA, 19 bp, Artificial Sequence
  Synthetic construct
tcccaccttccactcctat

SEQ ID NO: 473 - DNA, 20 bp, Artificial Sequence
  Synthetic construct
gtccactcacctccatacca

SEQ ID NO: 474 - DNA, 19 bp, Artificial Sequence
  Synthetic construct
gtccactcacctccatacc

SEQ ID NO: 475 - DNA, 19 bp, Artificial Sequence
  Synthetic construct
tccactcacctccatacca

SEQ ID NO: 476 - DNA, 21 bp, Artificial Sequence
  Synthetic construct
gtccactcacctccataccaa

SEQ ID NO: 477 - DNA, 20 bp, Artificial Sequence
  Synthetic construct
tccactcacctccataccaa

SEQ ID NO: 478 - DNA, 21 bp, Artificial Sequence
  Synthetic construct
ccactcacctccataccaagc

SEQ ID NO: 479 - DNA, 19 bp, Artificial Sequence
  Synthetic construct
ccactcacctccataccaa

SEQ ID NO: 480 - DNA, 21 bp, Artificial Sequence
  Synthetic construct
tccactcacctccataccaag

SEQ ID NO: 481 - DNA, 20 bp, Artificial Sequence
  Synthetic construct
ccactcacctccataccaag

SEQ ID NO: 482 - DNA, 19 bp, Artificial Sequence
  Synthetic construct
atgccaagggtccactcac

SEQ ID NO: 483 - DNA, 20 bp, Artificial Sequence
  Synthetic construct
accacctcccattccaccca

SEQ ID NO: 484 - DNA, 20 bp, Artificial Sequence
  Synthetic construct
acctcccataccacctccca

SEQ ID NO: 485 - DNA, 20 bp, Artificial Sequence
  Synthetic construct
taccacctcccattccaccc

SEQ ID NO: 486 - DNA, 21 bp, Artificial Sequence
  Synthetic construct
taccacctcccattccaccca

SEQ ID NO: 487 - DNA, 20 bp, Artificial Sequence
  Synthetic construct
ccacctcccattccacccat

SEQ ID NO: 488 - DNA, 20 bp, Artificial Sequence
  Synthetic construct
cctcccataccacctcccat

SEQ ID NO: 489 - DNA, 20 bp, Artificial Sequence
  Synthetic construct
tgccacctcccataccacct

SEQ ID NO: 490 - DNA, 21 bp, Artificial Sequence
  Synthetic construct
accacctcccattccacccat

SEQ ID NO: 491 - DNA, 21 bp, Artificial Sequence
  Synthetic construct
acctcccataccacctcccat

SEQ ID NO: 492 - DNA, 21 bp, Artificial Sequence
  Synthetic construct
ccacctcccattccacccatt

SEQ ID NO: 493 - DNA, 20 bp, Artificial Sequence
  Synthetic construct
gtcccgcacaccctcttctt

SEQ ID NO: 494 - DNA, 21 bp, Artificial Sequence
  Synthetic construct
gtcccgcacaccctcttcttt

SEQ ID NO: 495 - DNA, 20 bp, Artificial Sequence
  Synthetic construct
tcccgcacaccctcttcttt

SEQ ID NO: 496 - DNA, 19 bp, Artificial Sequence
  Synthetic construct
tcccgcacaccctcttctt

SEQ ID NO: 497 - DNA, 21 bp, Artificial Sequence
  Synthetic construct
tcccgcacaccctcttcttta

SEQ ID NO: 498 - DNA, 20 bp, Artificial Sequence
  Synthetic construct
ccctgtgccttcttcttcct

SEQ ID NO: 499 - DNA, 21 bp, Artificial Sequence
  Synthetic construct
ccctgtgccttcttcttcctt

SEQ ID NO: 500 - DNA, 21 bp, Artificial Sequence
  Synthetic construct
actccaccttgttcactgcca

SEQ ID NO: 501 - DNA, 21 bp, Artificial Sequence
  Synthetic construct
gacttcccgagccattccttc

SEQ ID NO: 502 - DNA, 21 bp, Artificial Sequence
  Synthetic construct
tccaccatgttctccactcgc

SEQ ID NO: 503 - DNA, 19 bp, Artificial Sequence
  Synthetic construct
ctctgttcttctctcttcc

SEQ ID NO: 504 - DNA, 20 bp, Artificial Sequence
  Synthetic construct
gctccgtgttctgactcttg

SEQ ID NO: 505 - DNA, 20 bp, Artificial Sequence
  Synthetic construct
gtgtttccatcctccgcctc

SEQ ID NO: 506 - DNA, 19 bp, Artificial Sequence
  Synthetic construct
gctccgtgttctgactctt

SEQ ID NO: 507 - DNA, 20 bp, Artificial Sequence
  Synthetic construct
tgtttccatcctccgcctcc

SEQ ID NO: 508 - DNA, 21 bp, Artificial Sequence
  Synthetic construct
cactctgttcttctctcttcc

SEQ ID NO: 509 - DNA, 21 bp, Artificial Sequence
  Synthetic construct
actctgttcttctctcttcca

SEQ ID NO: 510 - DNA, 19 bp, Artificial Sequence
  Synthetic construct
gtgtttccatcctccgcct

SEQ ID NO: 511 - DNA, 20 bp, Artificial Sequence
  Synthetic construct
ctctgttcttctctcttcca

SEQ ID NO: 512 - DNA, 20 bp, Artificial Sequence
  Synthetic construct
actctgttcttctctcttcc

SEQ ID NO: 513 - DNA, 21 bp, Artificial Sequence
  Synthetic construct
tctcccacatctgctttgccc

SEQ ID NO: 514 - DNA, 20 bp, Artificial Sequence
  Synthetic construct
ctcccacatctgctttgccc

SEQ ID NO: 515 - DNA, 21 bp, Artificial Sequence
  Synthetic construct
tcccacatctgctttgcccga

SEQ ID NO: 516 - DNA, 20 bp, Artificial Sequence
  Synthetic construct
tcccacatctgctttgcccg

SEQ ID NO: 517 - DNA, 20 bp, Artificial Sequence
  Synthetic construct
tctcccacatctgctttgcc

SEQ ID NO: 518 - DNA, 19 bp, Artificial Sequence
  Synthetic construct
tcccacatctgctttgccc

SEQ ID NO: 519 - DNA, 20 bp, Artificial Sequence
  Synthetic construct
aagctctccgtccttgccac

SEQ ID NO: 520 - DNA, 21 bp, Artificial Sequence
  Synthetic construct
atctcccacatctgctttgcc

SEQ ID NO: 521 - DNA, 21 bp, Artificial Sequence
  Synthetic construct
cactttcctgtccttgggcgt

SEQ ID NO: 522 - DNA, 19 bp, Artificial Sequence
  Synthetic construct
ctcccacatctgctttgcc

SEQ ID NO: 523 - DNA, 20 bp, Artificial Sequence
  Synthetic construct
ctgtggctgggtctgtctgt

SEQ ID NO: 524 - DNA, 20 bp, Artificial Sequence
  Synthetic construct
tgtggctgggtctgtctgtc

SEQ ID NO: 525 - DNA, 20 bp, Artificial Sequence
  Synthetic construct
ggtctgtctgtcctctggct

SEQ ID NO: 526 - DNA, 20 bp, Artificial Sequence
  Synthetic construct
gctgggtctgtctgtcctct

SEQ ID NO: 527 - DNA, 20 bp, Artificial Sequence
  Synthetic construct
gtctgtctgtcctctggctt

SEQ ID NO: 528 - DNA, 19 bp, Artificial Sequence
  Synthetic construct
gtctgtctgtcctctggct

SEQ ID NO: 529 - DNA, 21 bp, Artificial Sequence
  Synthetic construct
ggtctgtctgtcctctggctt

SEQ ID NO: 530 - DNA, 21 bp, Artificial Sequence
  Synthetic construct
gtctgtctgtcctctggcttg

SEQ ID NO: 531 - DNA, 21 bp, Artificial Sequence
  Synthetic construct
ggtttgggctctggatggtct

SEQ ID NO: 532 - DNA, 20 bp, Artificial Sequence
  Synthetic construct
gggtttgggctctggatggt

SEQ ID NO: 533 - DNA, 20 bp, Artificial Sequence
  Synthetic construct
ccactccctgcctcctgata

SEQ ID NO: 534 - DNA, 21 bp, Artificial Sequence
  Synthetic construct
ccactccctgcctcctgatat

SEQ ID NO: 535 - DNA, 20 bp, Artificial Sequence
  Synthetic construct
cactccctgcctcctgatat

SEQ ID NO: 536 - DNA, 19 bp, Artificial Sequence
  Synthetic construct
cactccctgcctcctgata

SEQ ID NO: 537 - DNA, 21 bp, Artificial Sequence
  Synthetic construct
gtggtggtgtgatgggtgtgt

SEQ ID NO: 538 - DNA, 21 bp, Artificial Sequence
  Synthetic construct
cactccctgcctcctgatatg

SEQ ID NO: 539 - DNA, 20 bp, Artificial Sequence
  Synthetic construct
actccctgcctcctgatatg

SEQ ID NO: 540 - DNA, 21 bp, Artificial Sequence
  Synthetic construct
gcctccactcatccagattcc

SEQ ID NO: 541 - DNA, 19 bp, Artificial Sequence
  Synthetic construct
actccctgcctcctgatat

SEQ ID NO: 542 - DNA, 20 bp, Artificial Sequence
  Synthetic construct
ggtggtgtgatgggtgtgtg

SEQ ID NO: 543 - DNA, 20 bp, Artificial Sequence
  Synthetic construct
actcctccctttctctcatt

SEQ ID NO: 544 - DNA, 19 bp, Artificial Sequence
  Synthetic construct
actcctccctttctctcat

SEQ ID NO: 545 - DNA, 19 bp, Artificial Sequence
  Synthetic construct
gactcctccctttctctca

SEQ ID NO: 546 - DNA, 20 bp, Artificial Sequence
  Synthetic construct
gactcctccctttctctcat

SEQ ID NO: 547 - DNA, 21 bp, Artificial Sequence
  Synthetic construct
actcctccctttctctcattg

SEQ ID NO: 548 - DNA, 21 bp, Artificial Sequence
  Synthetic construct
gactcctccctttctctcatt

SEQ ID NO: 549 - DNA, 19 bp, Artificial Sequence
  Synthetic construct
ctcctccctttctctcatt

SEQ ID NO: 550 - DNA, 20 bp, Artificial Sequence
  Synthetic construct
ctcctccctttctctcattg

SEQ ID NO: 551 - DNA, 19 bp, Artificial Sequence
  Synthetic construct
tcctccctttctctcattg

SEQ ID NO: 552 - DNA, 21 bp, Artificial Sequence
  Synthetic construct
ctcctccctttctctcattga

SEQ ID NO: 553 - DNA, 19 bp, Artificial Sequence
  Synthetic construct
tgtcgggtagcttatcaga

SEQ ID NO: 554 - DNA, 20 bp, Artificial Sequence
  Synthetic construct
gtcgggtagcttatcagact

SEQ ID NO: 555 - DNA, 21 bp, Artificial Sequence
  Synthetic construct
cttatcagactgatgttgact

SEQ ID NO: 556 - DNA, 25 bp, Artificial Sequence
  Synthetic construct
ttatcagactgatgttgactgttga

SEQ ID NO: 557 - DNA, 20 bp, Artificial Sequence
  Synthetic construct
gactgatgttgactgttgaa

SEQ ID NO: 558 - DNA, 20 bp, Artificial Sequence
  Synthetic construct
tgttgactgttgaatctcat

SEQ ID NO: 559 - DNA, 24 bp, Artificial Sequence
  Synthetic construct
gttgactgttgaatctcatggcaa

SEQ ID NO: 560 - DNA, 22 bp, Artificial Sequence
  Synthetic construct
caccagtcgatgggctgtctga

SEQ ID NO: 561 - DNA, 24 bp, Artificial Sequence
  Synthetic construct
tcagactgatgttgactgttgaat

SEQ ID NO: 562 - DNA, 21 bp, Artificial Sequence
  Synthetic construct
gactgttgaatctcatggcaa

SEQ ID NO: 563 - DNA, 21 bp, Artificial Sequence
  Synthetic construct
cccttcatgcttcactttccc

SEQ ID NO: 564 - DNA, 21 bp, Artificial Sequence
  Synthetic construct
tcccttcatgcttcactttcc

SEQ ID NO: 565 - DNA, 20 bp, Artificial Sequence
  Synthetic construct
ccttcatgcttcactttccc

SEQ ID NO: 566 - DNA, 20 bp, Artificial Sequence
  Synthetic construct
ccctccgccatgaccatagt

SEQ ID NO: 567 - DNA, 20 bp, Artificial Sequence
  Synthetic construct
acttccacacaccttcatct

SEQ ID NO: 568 - DNA, 21 bp, Artificial Sequence
  Synthetic construct
acttccacacaccttcatctt

SEQ ID NO: 569 - DNA, 20 bp, Artificial Sequence
  Synthetic construct
cttccacacaccttcatctt

SEQ ID NO: 570 - DNA, 21 bp, Artificial Sequence
  Synthetic construct
tacttccacacaccttcatct

SEQ ID NO: 571 - DNA, 19 bp, Artificial Sequence
  Synthetic construct
cttccacacaccttcatct

SEQ ID NO: 572 - DNA, 20 bp, Artificial Sequence
  Synthetic construct
tccgccatgaccatagtgcc

SEQ ID NO: 573 - DNA, 21 bp, Artificial Sequence
  Synthetic construct
gcacttacatcacccactcca

SEQ ID NO: 574 - DNA, 20 bp, Artificial Sequence
  Synthetic construct
cacttacatcacccactcca

SEQ ID NO: 575 - DNA, 20 bp, Artificial Sequence
  Synthetic construct
gcacttacatcacccactcc

SEQ ID NO: 576 - DNA, 19 bp, Artificial Sequence
  Synthetic construct
cacttacatcacccactcc

SEQ ID NO: 577 - DNA, 19 bp, Artificial Sequence
  Synthetic construct
acttacatcacccactcca

SEQ ID NO: 578 - DNA, 20 bp, Artificial Sequence
  Synthetic construct
cctttctcctgttcttgttc

SEQ ID NO: 579 - DNA, 21 bp, Artificial Sequence
  Synthetic construct
cacttacatcacccactccaa

SEQ ID NO: 580 - DNA, 19 bp, Artificial Sequence
  Synthetic construct
cttcatccctgccttcgtt

SEQ ID NO: 581 - DNA, 20 bp, Artificial Sequence
  Synthetic construct
acccatgcctccactgtctt

SEQ ID NO: 582 - DNA, 21 bp, Artificial Sequence
  Synthetic construct
actccactttaacttcatccc

SEQ ID NO: 583 - DNA, 20 bp, Artificial Sequence
  Synthetic construct
gttcccgttccctctcagca

SEQ ID NO: 584 - DNA, 20 bp, Artificial Sequence
  Synthetic construct
ttcccgttccctctcagcac

SEQ ID NO: 585 - DNA, 20 bp, Artificial Sequence
  Synthetic construct
cccattccctctgcctgtga

SEQ ID NO: 586 - DNA, 20 bp, Artificial Sequence
  Synthetic construct
tcccgttccctctcagcact

SEQ ID NO: 587 - DNA, 20 bp, Artificial Sequence
  Synthetic construct
gttccctcgcatccttgtcc

SEQ ID NO: 588 - DNA, 21 bp, Artificial Sequence
  Synthetic construct
tcccgttccctctcagcactt

SEQ ID NO: 589 - DNA, 21 bp, Artificial Sequence
  Synthetic construct
ttcccgttccctctcagcact

SEQ ID NO: 590 - DNA, 19 bp, Artificial Sequence
  Synthetic construct
ttcccgttccctctcagca

SEQ ID NO: 591 - DNA, 20 bp, Artificial Sequence
  Synthetic construct
cccgttccctctcagcactt

SEQ ID NO: 592 - DNA, 21 bp, Artificial Sequence
  Synthetic construct
cccttcctctcttcgtgtctc

SEQ ID NO: 593 - DNA, 20 bp, Artificial Sequence
  Synthetic construct
gtccgctgtgtctccctttc

SEQ ID NO: 594 - DNA, 20 bp, Artificial Sequence
  Synthetic construct
tccgctgtgtctccctttcc

SEQ ID NO: 595 - DNA, 19 bp, Artificial Sequence
  Synthetic construct
gtccgctgtgtctcccttt

SEQ ID NO: 596 - DNA, 19 bp, Artificial Sequence
  Synthetic construct
tccgctgtgtctccctttc

SEQ ID NO: 597 - DNA, 20 bp, Artificial Sequence
  Synthetic construct
tgcctccttccatgtcctcc

SEQ ID NO: 598 - DNA, 20 bp, Artificial Sequence
  Synthetic construct
cctccttccatgtcctccgt

SEQ ID NO: 599 - DNA, 20 bp, Artificial Sequence
  Synthetic construct
tccttccatgtcctccgtcc

SEQ ID NO: 600 - DNA, 20 bp, Artificial Sequence
  Synthetic construct
ggtccgctgtgtctcccttt

SEQ ID NO: 601 - DNA, 21 bp, Artificial Sequence
  Synthetic construct
tccttccatgtcctccgtcca

SEQ ID NO: 602 - DNA, 20 bp, Artificial Sequence
  Synthetic construct
ctccttccatgtcctccgtc

SEQ ID NO: 603 - DNA, 20 bp, Artificial Sequence
  Synthetic construct
cctccacctccttctgcctt

SEQ ID NO: 604 - DNA, 20 bp, Artificial Sequence
  Synthetic construct
tcttgtgtcgcctcctccca

SEQ ID NO: 605 - DNA, 21 bp, Artificial Sequence
  Synthetic construct
cctccacctccttctgccttt

SEQ ID NO: 606 - DNA, 20 bp, Artificial Sequence
  Synthetic construct
atcttgtgtcgcctcctccc

SEQ ID NO: 607 - DNA, 21 bp, Artificial Sequence
  Synthetic construct
atcttgtgtcgcctcctccca

SEQ ID NO: 608 - DNA, 21 bp, Artificial Sequence
  Synthetic construct
tcccatcttgtgtcgcctcct

SEQ ID NO: 609 - DNA, 20 bp, Artificial Sequence
  Synthetic construct
cctcccatcttgtgtcgcct

SEQ ID NO: 610 - DNA, 20 bp, Artificial Sequence
  Synthetic construct
tcccatcttgtgtcgcctcc

SEQ ID NO: 611 - DNA, 20 bp, Artificial Sequence
  Synthetic construct
ctccacctccttctgccttt

SEQ ID NO: 612 - DNA, 19 bp, Artificial Sequence
  Synthetic construct
ctccacctccttctgcctt

SEQ ID NO: 613 - DNA, 20 bp, Artificial Sequence
  Synthetic construct
acccacctcctttcctcagc

SEQ ID NO: 614 - DNA, 20 bp, Artificial Sequence
  Synthetic construct
gacccacctcctttcctcag

SEQ ID NO: 615 - DNA, 19 bp, Artificial Sequence
  Synthetic construct
acccacctcctttcctcag

SEQ ID NO: 616 - DNA, 19 bp, Artificial Sequence
  Synthetic construct
gacccacctcctttcctca

SEQ ID NO: 617 - DNA, 20 bp, Artificial Sequence
  Synthetic construct
gcctagacccacctcctttc

SEQ ID NO: 618 - DNA, 21 bp, Artificial Sequence
  Synthetic construct
cctagacccacctcctttcct

SEQ ID NO: 619 - DNA, 21 bp, Artificial Sequence
  Synthetic construct
tccactccttctgttccgtca

SEQ ID NO: 620 - DNA, 20 bp, Artificial Sequence
  Synthetic construct
tccactccttctgttccgtc

SEQ ID NO: 621 - DNA, 20 bp, Artificial Sequence
  Synthetic construct
ctgcctagacccacctcctt

SEQ ID NO: 622 - DNA, 20 bp, Artificial Sequence
  Synthetic construct
cctagacccacctcctttcc

SEQ ID NO: 623 - DNA, 20 bp, Artificial Sequence
  Synthetic construct
tccctgctcccgactcttca

SEQ ID NO: 624 - DNA, 21 bp, Artificial Sequence
  Synthetic construct
tccctgctcccgactcttcat

SEQ ID NO: 625 - DNA, 20 bp, Artificial Sequence
  Synthetic construct
ccctgctcccgactcttcat

SEQ ID NO: 626 - DNA, 21 bp, Artificial Sequence
  Synthetic construct
ccctgctcccgactcttcatt

SEQ ID NO: 627 - DNA, 21 bp, Artificial Sequence
  Synthetic construct
cctgctcccgactcttcattc

SEQ ID NO: 628 - DNA, 20 bp, Artificial Sequence
  Synthetic construct
cctgctcccgactcttcatt

SEQ ID NO: 629 - DNA, 19 bp, Artificial Sequence
  Synthetic construct
cctgctcccgactcttcat

SEQ ID NO: 630 - DNA, 20 bp, Artificial Sequence
  Synthetic construct
ctgctcccgactcttcattc

SEQ ID NO: 631 - DNA, 21 bp, Artificial Sequence
  Synthetic construct
ggtcctctgcactcctttgtc

SEQ ID NO: 632 - DNA, 20 bp, Artificial Sequence
  Synthetic construct
gcctgtgccacttctttgct

SEQ ID NO: 633 - DNA, 21 bp, Artificial Sequence
  Synthetic construct
tcctcttcttcctccttctct

SEQ ID NO: 634 - DNA, 21 bp, Artificial Sequence
  Synthetic construct
catccctctcatatcgccaca

SEQ ID NO: 635 - DNA, 20 bp, Artificial Sequence
  Synthetic construct
tccctctcatatcgccacag

SEQ ID NO: 636 - DNA, 20 bp, Artificial Sequence
  Synthetic construct
cctcttcttcctccttctct

SEQ ID NO: 637 - DNA, 20 bp, Artificial Sequence
  Synthetic construct
catccctctcatatcgccac

SEQ ID NO: 638 - DNA, 20 bp, Artificial Sequence
  Synthetic construct
tcctcttcttcctccttctc

SEQ ID NO: 639 - DNA, 21 bp, Artificial Sequence
  Synthetic construct
atccctctcatatcgccacag

SEQ ID NO: 640 - DNA, 20 bp, Artificial Sequence
  Synthetic construct
atccctctcatatcgccaca

SEQ ID NO: 641 - DNA, 21 bp, Artificial Sequence
  Synthetic construct
cctcttcttcctccttctctt

SEQ ID NO: 642 - DNA, 19 bp, Artificial Sequence
  Synthetic construct
tccctctcatatcgccaca

SEQ ID NO: 643 - DNA, 20 bp, Artificial Sequence
  Synthetic construct
attctcctgccacagcctcc

SEQ ID NO: 644 - DNA, 21 bp, Artificial Sequence
  Synthetic construct
gctcacggtgtcttcattccc

SEQ ID NO: 645 - DNA, 20 bp, Artificial Sequence
  Synthetic construct
tccattctcgcgcctcctct

SEQ ID NO: 646 - DNA, 20 bp, Artificial Sequence
  Synthetic construct
acggcctccacctccattct

SEQ ID NO: 647 - DNA, 20 bp, Artificial Sequence
  Synthetic construct
agcgattctcctgccacagc

SEQ ID NO: 648 - DNA, 21 bp, Artificial Sequence
  Synthetic construct
tccattctcgcgcctcctctt

SEQ ID NO: 649 - DNA, 20 bp, Artificial Sequence
  Synthetic construct
ccattctcgcgcctcctctt

SEQ ID NO: 650 - DNA, 20 bp, Artificial Sequence
  Synthetic construct
ggcacatttccttcccttgc

SEQ ID NO: 651 - DNA, 20 bp, Artificial Sequence
  Synthetic construct
ggtgagtagcccagatgcca

SEQ ID NO: 652 - DNA, 20 bp, Artificial Sequence
  Synthetic construct
agcttctctgcgcctttccg

SEQ ID NO: 653 - DNA, 20 bp, Artificial Sequence
  Synthetic construct
cacacctgccaactccacca

SEQ ID NO: 654 - DNA, 21 bp, Artificial Sequence
  Synthetic construct
cacacctgccaactccaccat

SEQ ID NO: 655 - DNA, 20 bp, Artificial Sequence
  Synthetic construct
acacctgccaactccaccat

SEQ ID NO: 656 - DNA, 19 bp, Artificial Sequence
  Synthetic construct
acacctgccaactccacca

SEQ ID NO: 657 - DNA, 20 bp, Artificial Sequence
  Synthetic construct
cacctgccaactccaccatt

SEQ ID NO: 658 - DNA, 21 bp, Artificial Sequence
  Synthetic construct
acacctgccaactccaccatt

SEQ ID NO: 659 - DNA, 19 bp, Artificial Sequence
  Synthetic construct
cacctgccaactccaccat

SEQ ID NO: 660 - DNA, 21 bp, Artificial Sequence
  Synthetic construct
cacctgccaactccaccattg

SEQ ID NO: 661 - DNA, 19 bp, Artificial Sequence
  Synthetic construct
acctgccaactccaccatt

SEQ ID NO: 662 - DNA, 20 bp, Artificial Sequence
  Synthetic construct
acctgccaactccaccattg

SEQ ID NO: 663 - DNA, 20 bp, Artificial Sequence
  Synthetic construct
gtcttccgccaccttgatct

SEQ ID NO: 664 - DNA, 21 bp, Artificial Sequence
  Synthetic construct
gtcttccgccaccttgatctt

SEQ ID NO: 665 - DNA, 21 bp, Artificial Sequence
  Synthetic construct
gctccacctccttcatatcca

SEQ ID NO: 666 - DNA, 20 bp, Artificial Sequence
  Synthetic construct
gctccacctccttcatatcc

SEQ ID NO: 667 - DNA, 21 bp, Artificial Sequence
  Synthetic construct
ccacctccttcatatccacct

SEQ ID NO: 668 - DNA, 19 bp, Artificial Sequence
  Synthetic construct
gtcttccgccaccttgatc

SEQ ID NO: 669 - DNA, 21 bp, Artificial Sequence
  Synthetic construct
tcttccgccaccttgatcttc

SEQ ID NO: 670 - DNA, 21 bp, Artificial Sequence
  Synthetic construct
tccacctccttcatatccacc

SEQ ID NO: 671 - DNA, 21 bp, Artificial Sequence
  Synthetic construct
actcattcagctccacctcct

SEQ ID NO: 672 - DNA, 20 bp, Artificial Sequence
  Synthetic construct
tctcaccgctcctgccacat

SEQ ID NO: 673 - DNA, 21 bp, Artificial Sequence
  Synthetic construct
gtcttgtcccattccttcacc

SEQ ID NO: 674 - DNA, 21 bp, Artificial Sequence
  Synthetic construct
tcttgtcccattccttcacca

SEQ ID NO: 675 - DNA, 20 bp, Artificial Sequence
  Synthetic construct
tcttgtcccattccttcacc

SEQ ID NO: 676 - DNA, 20 bp, Artificial Sequence
  Synthetic construct
gtcttgtcccattccttcac

SEQ ID NO: 677 - DNA, 20 bp, Artificial Sequence
  Synthetic construct
cttgtcccattccttcacca

SEQ ID NO: 678 - DNA, 19 bp, Artificial Sequence
  Synthetic construct
gtcccattccttcaccagt

SEQ ID NO: 679 - DNA, 20 bp, Artificial Sequence
  Synthetic construct
tgtcccattccttcaccagt

SEQ ID NO: 680 - DNA, 19 bp, Artificial Sequence
  Synthetic construct
gtcttgtcccattccttca

SEQ ID NO: 681 - DNA, 20 bp, Artificial Sequence
  Synthetic construct
acaaatcttcctcttctccc

SEQ ID NO: 682 - DNA, 19 bp, Artificial Sequence
  Synthetic construct
caaatcttcctcttctccc

SEQ ID NO: 683 - DNA, 19 bp, Artificial Sequence
  Synthetic construct
tccctcagacagttccttc

SEQ ID NO: 684 - DNA, 20 bp, Artificial Sequence
  Synthetic construct
atccctcagacagttccttc

SEQ ID NO: 685 - DNA, 21 bp, Artificial Sequence
  Synthetic construct
aacaaatcttcctcttctccc

SEQ ID NO: 686 - DNA, 19 bp, Artificial Sequence
  Synthetic construct
atccctcagacagttcctt

SEQ ID NO: 687 - DNA, 19 bp, Artificial Sequence
  Synthetic construct
aggctctgggactaggaca

SEQ ID NO: 688 - DNA, 20 bp, Artificial Sequence
  Synthetic construct
cagccagtcccagtggttca

SEQ ID NO: 689 - DNA, 20 bp, Artificial Sequence
  Synthetic construct
agccagtcccagtggttcac

SEQ ID NO: 690 - DNA, 20 bp, Artificial Sequence
  Synthetic construct
tccctcagacagttccttct

SEQ ID NO: 691 - DNA, 19 bp, Artificial Sequence
  Synthetic construct
cggagctcagtacaggtct

SEQ ID NO: 692 - DNA, 20 bp, Artificial Sequence
  Synthetic construct
cggagctcagtacaggtctg

SEQ ID NO: 693 - DNA, 19 bp, Artificial Sequence
  Synthetic construct
ggagctcagtacaggtctg

SEQ ID NO: 694 - DNA, 21 bp, Artificial Sequence
  Synthetic construct
cacggagctcagtacaggtct

SEQ ID NO: 695 - DNA, 21 bp, Artificial Sequence
  Synthetic construct
ctcacggagctcagtacaggt

SEQ ID NO: 696 - DNA, 21 bp, Artificial Sequence
  Synthetic construct
tcacggagctcagtacaggtc

SEQ ID NO: 697 - DNA, 20 bp, Artificial Sequence
  Synthetic construct
cacggagctcagtacaggtc

SEQ ID NO: 698 - DNA, 21 bp, Artificial Sequence
  Synthetic construct
cagagttatttatcctcacgg

SEQ ID NO: 699 - DNA, 19 bp, Artificial Sequence
  Synthetic construct
gagttatttatcctcacgg

SEQ ID NO: 700 - DNA, 19 bp, Artificial Sequence
  Synthetic construct
agagagagttcagttcgta

SEQ ID NO: 701 - DNA, 19 bp, Artificial Sequence
  Synthetic construct
ttctccactaatccatcag

SEQ ID NO: 702 - DNA, 19 bp, Artificial Sequence
  Synthetic construct
gagagagttcagttcgtaa

SEQ ID NO: 703 - DNA, 19 bp, Artificial Sequence
  Synthetic construct
tctccactaatccatcaga

SEQ ID NO: 704 - DNA, 19 bp, Artificial Sequence
  Synthetic construct
ctccactaatccatcagaa

SEQ ID NO: 705 - DNA, 21 bp, Artificial Sequence
  Synthetic construct
ctccactaatccatcagaaag

SEQ ID NO: 706 - DNA, 21 bp, Artificial Sequence
  Synthetic construct
gaaagagagagttcagttcgt

SEQ ID NO: 707 - DNA, 19 bp, Artificial Sequence
  Synthetic construct
aagagagagttcagttcgt

SEQ ID NO: 708 - DNA, 19 bp, Artificial Sequence
  Synthetic construct
ccatcagaaagagagagtt

SEQ ID NO: 709 - DNA, 21 bp, Artificial Sequence
  Synthetic construct
ccatcagaaagagagagttca

SEQ ID NO: 710 - DNA, 21 bp, Artificial Sequence
  Synthetic construct
cttgaaagttcagccatatgc

SEQ ID NO: 711 - DNA, 19 bp, Artificial Sequence
  Synthetic construct
tgaaagttcagccatatgc

SEQ ID NO: 712 - DNA, 21 bp, Artificial Sequence
  Synthetic construct
catcacttgaaagttcagcca

SEQ ID NO: 713 - DNA, 21 bp, Artificial Sequence
  Synthetic construct
acatcacttgaaagttcagcc

SEQ ID NO: 714 - DNA, 19 bp, Artificial Sequence
  Synthetic construct
tcacttgaaagttcagcca

SEQ ID NO: 715 - DNA, 20 bp, Artificial Sequence
  Synthetic construct
catcacttgaaagttcagcc

SEQ ID NO: 716 - DNA, 19 bp, Artificial Sequence
  Synthetic construct
cacttgaaagttcagccat

SEQ ID NO: 717 - DNA, 21 bp, Artificial Sequence
  Synthetic construct
gacatcacttgaaagttcagc

SEQ ID NO: 718 - DNA, 19 bp, Artificial Sequence
  Synthetic construct
atcacttgaaagttcagcc

SEQ ID NO: 719 - DNA, 19 bp, Artificial Sequence
  Synthetic construct
catcacttgaaagttcagc

SEQ ID NO: 720 - DNA, 20 bp, Artificial Sequence
  Synthetic construct
gtacctcacagaacatcagc

SEQ ID NO: 721 - DNA, 19 bp, Artificial Sequence
  Synthetic construct
tacctcacagaacatcagc

SEQ ID NO: 722 - DNA, 19 bp, Artificial Sequence
  Synthetic construct
gtacctcacagaacatcag

SEQ ID NO: 723 - DNA, 21 bp, Artificial Sequence
  Synthetic construct
gtacctcacagaacatcagct

SEQ ID NO: 724 - DNA, 21 bp, Artificial Sequence
  Synthetic construct
gccatcagaactctaacatgc

SEQ ID NO: 725 - DNA, 20 bp, Artificial Sequence
  Synthetic construct
acctcacagaacatcagctt

SEQ ID NO: 726 - DNA, 21 bp, Artificial Sequence
  Synthetic construct
acctcacagaacatcagctta

SEQ ID NO: 727 - DNA, 21 bp, Artificial Sequence
  Synthetic construct
tacctcacagaacatcagctt

SEQ ID NO: 728 - DNA, 19 bp, Artificial Sequence
  Synthetic construct
acctcacagaacatcagct

SEQ ID NO: 729 - DNA, 19 bp, Artificial Sequence
  Synthetic construct
cctcacagaacatcagctt

SEQ ID NO: 730 - DNA, 19 bp, Artificial Sequence
  Synthetic construct
gtttctcaggtgttcatgt

SEQ ID NO: 731 - DNA, 21 bp, Artificial Sequence
  Synthetic construct
gtcggtcatagtgagctagtt

SEQ ID NO: 732 - DNA, 20 bp, Artificial Sequence
  Synthetic construct
gtcggtcatagtgagctagt

SEQ ID NO: 733 - DNA, 21 bp, Artificial Sequence
  Synthetic construct
tgtcggtcatagtgagctagt

SEQ ID NO: 734 - DNA, 21 bp, Artificial Sequence
  Synthetic construct
ctgtcggtcatagtgagctag

SEQ ID NO: 735 - DNA, 19 bp, Artificial Sequence
  Synthetic construct
ctgtcggtcatagtgagct

SEQ ID NO: 736 - DNA, 20 bp, Artificial Sequence
  Synthetic construct
actgtcggtcatagtgagct

SEQ ID NO: 737 - DNA, 20 bp, Artificial Sequence
  Synthetic construct
ctgtcggtcatagtgagcta

SEQ ID NO: 738 - DNA, 21 bp, Artificial Sequence
  Synthetic construct
actgtcggtcatagtgagcta

SEQ ID NO: 739 - DNA, 21 bp, Artificial Sequence
  Synthetic construct
tcggtcatagtgagctagttt

SEQ ID NO: 740 - DNA, 21 bp, Artificial Sequence
  Synthetic construct
gtctcaacagcaagtcatcag

SEQ ID NO: 741 - DNA, 21 bp, Artificial Sequence
  Synthetic construct
agtctcaacagcaagtcatca

SEQ ID NO: 742 - DNA, 20 bp, Artificial Sequence
  Synthetic construct
gtctcaacagcaagtcatca

SEQ ID NO: 743 - DNA, 21 bp, Artificial Sequence
  Synthetic construct
cagccgaacgagattccatgt

SEQ ID NO: 744 - DNA, 20 bp, Artificial Sequence
  Synthetic construct
agtctcaacagcaagtcatc

SEQ ID NO: 745 - DNA, 21 bp, Artificial Sequence
  Synthetic construct
ctcaacagcaagtcatcagcc

SEQ ID NO: 746 - DNA, 19 bp, Artificial Sequence
  Synthetic construct
gtctcaacagcaagtcatc

SEQ ID NO: 747 - DNA, 20 bp, Artificial Sequence
  Synthetic construct
agccgaacgagattccatgt

SEQ ID NO: 748 - DNA, 19 bp, Artificial Sequence
  Synthetic construct
cgagattccatgtaagtca

SEQ ID NO: 749 - DNA, 21 bp, Artificial Sequence
  Synthetic construct
agccgaacgagattccatgta

SEQ ID NO: 750 - DNA, 21 bp, Artificial Sequence
  Synthetic construct
gggcggtattcaactcatcac

SEQ ID NO: 751 - DNA, 20 bp, Artificial Sequence
  Synthetic construct
gggcggtattcaactcatca

SEQ ID NO: 752 - DNA, 21 bp, Artificial Sequence
  Synthetic construct
ggcggtattcaactcatcact

SEQ ID NO: 753 - DNA, 19 bp, Artificial Sequence
  Synthetic construct
gggcggtattcaactcatc

SEQ ID NO: 754 - DNA, 20 bp, Artificial Sequence
  Synthetic construct
ggcggtattcaactcatcac

SEQ ID NO: 755 - DNA, 20 bp, Artificial Sequence
  Synthetic construct
gcggtattcaactcatcact

SEQ ID NO: 756 - DNA, 19 bp, Artificial Sequence
  Synthetic construct
ggcggtattcaactcatca

SEQ ID NO: 757 - DNA, 21 bp, Artificial Sequence
  Synthetic construct
gcggtattcaactcatcactg

SEQ ID NO: 758 - DNA, 21 bp, Artificial Sequence
  Synthetic construct
cggtattcaactcatcactgg

SEQ ID NO: 759 - DNA, 20 bp, Artificial Sequence
  Synthetic construct
ggtattcaactcatcactgg

SEQ ID NO: 760 - DNA, 20 bp, Artificial Sequence
  Synthetic construct
tctccctgtccttgttcctt

SEQ ID NO: 761 - DNA, 19 bp, Artificial Sequence
  Synthetic construct
tctccctgtccttgttcct

SEQ ID NO: 762 - DNA, 21 bp, Artificial Sequence
  Synthetic construct
tctccctgtccttgttccttt

SEQ ID NO: 763 - DNA, 20 bp, Artificial Sequence
  Synthetic construct
ctccctgtccttgttccttt

SEQ ID NO: 764 - DNA, 19 bp, Artificial Sequence
  Synthetic construct
ctccctgtccttgttcctt

SEQ ID NO: 765 - DNA, 21 bp, Artificial Sequence
  Synthetic construct
ctccctgtccttgttcctttg

SEQ ID NO: 766 - DNA, 20 bp, Artificial Sequence
  Synthetic construct
atctccctgtccttgttcct

SEQ ID NO: 767 - DNA, 21 bp, Artificial Sequence
  Synthetic construct
atctccctgtccttgttcctt

SEQ ID NO: 768 - DNA, 20 bp, Artificial Sequence
  Synthetic construct
tccctgtccttgttcctttg

SEQ ID NO: 769 - DNA, 19 bp, Artificial Sequence
  Synthetic construct
tccctgtccttgttccttt

SEQ ID NO: 770 - DNA, 19 bp, Artificial Sequence
  Synthetic construct
gttctctgtcccactctcg

SEQ ID NO: 771 - DNA, 21 bp, Artificial Sequence
  Synthetic construct
ctcggttctctgtcccactct

SEQ ID NO: 772 - DNA, 20 bp, Artificial Sequence
  Synthetic construct
tcctcaccagccatcttccc

SEQ ID NO: 773 - DNA, 21 bp, Artificial Sequence
  Synthetic construct
tcggttctctgtcccactctc

SEQ ID NO: 774 - DNA, 21 bp, Artificial Sequence
  Synthetic construct
tctcggttctctgtcccactc

SEQ ID NO: 775 - DNA, 21 bp, Artificial Sequence
  Synthetic construct
ctctgccacctcctctttcac

SEQ ID NO: 776 - DNA, 20 bp, Artificial Sequence
  Synthetic construct
ctctgccacctcctctttca

SEQ ID NO: 777 - DNA, 21 bp, Artificial Sequence
  Synthetic construct
tcctcaccagccatcttccca

SEQ ID NO: 778 - DNA, 21 bp, Artificial Sequence
  Synthetic construct
ctcctctctttcctctgtctc

SEQ ID NO: 779 - DNA, 21 bp, Artificial Sequence
  Synthetic construct
ctctcctctctttcctctgtc

SEQ ID NO: 780 - DNA, 21 bp, Artificial Sequence
  Synthetic construct
tcccacccatgcttagtaccc

SEQ ID NO: 781 - DNA, 21 bp, Artificial Sequence
  Synthetic construct
gagttcccacccatgcttagt

SEQ ID NO: 782 - DNA, 20 bp, Artificial Sequence
  Synthetic construct
tcccacccatgcttagtacc

SEQ ID NO: 783 - DNA, 20 bp, Artificial Sequence
  Synthetic construct
agttcccacccatgcttagt

SEQ ID NO: 784 - DNA, 21 bp, Artificial Sequence
  Synthetic construct
ttcccacccatgcttagtacc

SEQ ID NO: 785 - DNA, 20 bp, Artificial Sequence
  Synthetic construct
gagttcccacccatgcttag

SEQ ID NO: 786 - DNA, 19 bp, Artificial Sequence
  Synthetic construct
gttcccacccatgcttagt

SEQ ID NO: 787 - DNA, 21 bp, Artificial Sequence
  Synthetic construct
gttcccacccatgcttagtac

SEQ ID NO: 788 - DNA, 20 bp, Artificial Sequence
  Synthetic construct
gttcccacccatgcttagta

SEQ ID NO: 789 - DNA, 21 bp, Artificial Sequence
  Synthetic construct
cccacccatgcttagtaccct

SEQ ID NO: 790 - DNA, 19 bp, Artificial Sequence
  Synthetic construct
ccctccttctcctgcttca

SEQ ID NO: 791 - DNA, 21 bp, Artificial Sequence
  Synthetic construct
actcactgcctcccatcatca

SEQ ID NO: 792 - DNA, 20 bp, Artificial Sequence
  Synthetic construct
actcactgcctcccatcatc

SEQ ID NO: 793 - DNA, 20 bp, Artificial Sequence
  Synthetic construct
ccctccttctcctgcttcag

SEQ ID NO: 794 - DNA, 19 bp, Artificial Sequence
  Synthetic construct
actcactgcctcccatcat

SEQ ID NO: 795 - DNA, 20 bp, Artificial Sequence
  Synthetic construct
ctcactgcctcccatcatca

SEQ ID NO: 796 - DNA, 21 bp, Artificial Sequence
  Synthetic construct
gactcactgcctcccatcatc

SEQ ID NO: 797 - DNA, 20 bp, Artificial Sequence
  Synthetic construct
tccctttcttgtcatcacca

SEQ ID NO: 798 - DNA, 19 bp, Artificial Sequence
  Synthetic construct
ctcactgcctcccatcatc

SEQ ID NO: 799 - DNA, 21 bp, Artificial Sequence
  Synthetic construct
atccctttcttgtcatcacca

SEQ ID NO: 800 - DNA, 21 bp, Artificial Sequence
  Synthetic construct
cttcccacactcatcgcattc

SEQ ID NO: 801 - DNA, 20 bp, Artificial Sequence
  Synthetic construct
cccttaccacactccacaca

SEQ ID NO: 802 - DNA, 21 bp, Artificial Sequence
  Synthetic construct
acccttaccacactccacaca

SEQ ID NO: 803 - DNA, 20 bp, Artificial Sequence
  Synthetic construct
acccttaccacactccacac

SEQ ID NO: 804 - DNA, 20 bp, Artificial Sequence
  Synthetic construct
tcccacactcatcgcattca

SEQ ID NO: 805 - DNA, 21 bp, Artificial Sequence
  Synthetic construct
ttcccacactcatcgcattca

SEQ ID NO: 806 - DNA, 19 bp, Artificial Sequence
  Synthetic construct
cccttaccacactccacac

SEQ ID NO: 807 - DNA, 20 bp, Artificial Sequence
  Synthetic construct
cttcccacactcatcgcatt

SEQ ID NO: 808 - DNA, 20 bp, Artificial Sequence
  Synthetic construct
ttcccacactcatcgcattc

SEQ ID NO: 809 - DNA, 20 bp, Artificial Sequence
  Synthetic construct
gcttcccacactcatcgcat

SEQ ID NO: 810 - DNA, 21 bp, Artificial Sequence
  Synthetic construct
gtctcctgccacattcattct

SEQ ID NO: 811 - DNA, 20 bp, Artificial Sequence
  Synthetic construct
gtctcctgccacattcattc

SEQ ID NO: 812 - DNA, 21 bp, Artificial Sequence
  Synthetic construct
gtcaactctaatcctcccact

SEQ ID NO: 813 - DNA, 21 bp, Artificial Sequence
  Synthetic construct
tcctgccacattcattctacc

SEQ ID NO: 814 - DNA, 20 bp, Artificial Sequence
  Synthetic construct
tctcctgccacattcattct

SEQ ID NO: 815 - DNA, 21 bp, Artificial Sequence
  Synthetic construct
cctgccacattcattctacca

SEQ ID NO: 816 - DNA, 20 bp, Artificial Sequence
  Synthetic construct
tcaactctaatcctcccact

SEQ ID NO: 817 - DNA, 19 bp, Artificial Sequence
  Synthetic construct
gtctcctgccacattcatt

SEQ ID NO: 818 - DNA, 20 bp, Artificial Sequence
  Synthetic construct
cctgccacattcattctacc

SEQ ID NO: 819 - DNA, 21 bp, Artificial Sequence
  Synthetic construct
tctcctgccacattcattcta

SEQ ID NO: 820 - DNA, 20 bp, Artificial Sequence
  Synthetic construct
tcacccgtcacctcatccct

SEQ ID NO: 821 - DNA, 21 bp, Artificial Sequence
  Synthetic construct
ttcacccgtcacctcatccct

SEQ ID NO: 822 - DNA, 20 bp, Artificial Sequence
  Synthetic construct
ttcacccgtcacctcatccc

SEQ ID NO: 823 - DNA, 20 bp, Artificial Sequence
  Synthetic construct
gcccttgtgctctgcttctc

SEQ ID NO: 824 - DNA, 19 bp, Artificial Sequence
  Synthetic construct
gaccctcagagccaccttt

SEQ ID NO: 825 - DNA, 21 bp, Artificial Sequence
  Synthetic construct
cccttgtgctctgcttctcct

SEQ ID NO: 826 - DNA, 20 bp, Artificial Sequence
  Synthetic construct
cccttgtgctctgcttctcc

SEQ ID NO: 827 - DNA, 20 bp, Artificial Sequence
  Synthetic construct
gaccctcagagccacctttg

SEQ ID NO: 828 - DNA, 19 bp, Artificial Sequence
  Synthetic construct
gcccttgtgctctgcttct

SEQ ID NO: 829 - DNA, 21 bp, Artificial Sequence
  Synthetic construct
gtgcccttgtgctctgcttct

SEQ ID NO: 830 - DNA, 19 bp, Artificial Sequence
  Synthetic construct
agttctctgcctgccacca

SEQ ID NO: 831 - DNA, 20 bp, Artificial Sequence
  Synthetic construct
gttctctgcctgccaccaag

SEQ ID NO: 832 - DNA, 21 bp, Artificial Sequence
  Synthetic construct
tctgatgtgtcctgtgcctct

SEQ ID NO: 833 - DNA, 21 bp, Artificial Sequence
  Synthetic construct
agttctctgcctgccaccaag

SEQ ID NO: 834 - DNA, 20 bp, Artificial Sequence
  Synthetic construct
ctgatgtgtcctgtgcctct

SEQ ID NO: 835 - DNA, 20 bp, Artificial Sequence
  Synthetic construct
agttctctgcctgccaccaa

SEQ ID NO: 836 - DNA, 19 bp, Artificial Sequence
  Synthetic construct
gttctctgcctgccaccaa

SEQ ID NO: 837 - DNA, 20 bp, Artificial Sequence
  Synthetic construct
gctcttcagtctggcagggt

SEQ ID NO: 838 - DNA, 20 bp, Artificial Sequence
  Synthetic construct
ttctctgcctgccaccaagg

SEQ ID NO: 839 - DNA, 21 bp, Artificial Sequence
  Synthetic construct
ctgatgtgtcctgtgcctctt

SEQ ID NO: 840 - DNA, 21 bp, Artificial Sequence
  Synthetic construct
tcctcctcttcctcctcctct

SEQ ID NO: 841 - DNA, 20 bp, Artificial Sequence
  Synthetic construct
cctcctcttcctcctcctct

SEQ ID NO: 842 - DNA, 20 bp, Artificial Sequence
  Synthetic construct
tcctcctcttcctcctcctc

SEQ ID NO: 843 - DNA, 21 bp, Artificial Sequence
  Synthetic construct
cctcctcttcctcctcctctt

SEQ ID NO: 844 - DNA, 21 bp, Artificial Sequence
  Synthetic construct
cttcctcctcttcctcctcct

SEQ ID NO: 845 - DNA, 21 bp, Artificial Sequence
  Synthetic construct
cctcttcctcctcttcctcct

SEQ ID NO: 846 - DNA, 21 bp, Artificial Sequence
  Synthetic construct
ttcctcctcttcctcctcctc

SEQ ID NO: 847 - DNA, 21 bp, Artificial Sequence
  Synthetic construct
tcttcctcctcttcctcctcc

SEQ ID NO: 848 - DNA, 21 bp, Artificial Sequence
  Synthetic construct
tcctcttcctcctcttcctcc

SEQ ID NO: 849 - DNA, 20 bp, Artificial Sequence
  Synthetic construct
cttcctcctcttcctcctcc

SEQ ID NO: 850 - DNA, 20 bp, Artificial Sequence
  Synthetic construct
gatgacttccctgctcccac

SEQ ID NO: 851 - DNA, 20 bp, Artificial Sequence
  Synthetic construct
atgacttccctgctcccacg

SEQ ID NO: 852 - DNA, 21 bp, Artificial Sequence
  Synthetic construct
tgatgacttccctgctcccac

SEQ ID NO: 853 - DNA, 19 bp, Artificial Sequence
  Synthetic construct
atgacttccctgctcccac

SEQ ID NO: 854 - DNA, 20 bp, Artificial Sequence
  Synthetic construct
gtgatgacttccctgctccc

SEQ ID NO: 855 - DNA, 21 bp, Artificial Sequence
  Synthetic construct
gtgatgacttccctgctccca

SEQ ID NO: 856 - DNA, 19 bp, Artificial Sequence
  Synthetic construct
gatgacttccctgctccca

SEQ ID NO: 857 - DNA, 20 bp, Artificial Sequence
  Synthetic construct
tgatgacttccctgctccca

SEQ ID NO: 858 - DNA, 19 bp, Artificial Sequence
  Synthetic construct
tgatgacttccctgctccc

SEQ ID NO: 859 - DNA, 20 bp, Artificial Sequence
  Synthetic construct
gctttctgccctccactcag

SEQ ID NO: 860 - DNA, 20 bp, Artificial Sequence
  Synthetic construct
ccattccgtcatctctccca

SEQ ID NO: 861 - DNA, 20 bp, Artificial Sequence
  Synthetic construct
ctcccagttccagccttgca

SEQ ID NO: 862 - DNA, 21 bp, Artificial Sequence
  Synthetic construct
caccattccgtcatctctccc

SEQ ID NO: 863 - DNA, 21 bp, Artificial Sequence
  Synthetic construct
ccaccattccgtcatctctcc

SEQ ID NO: 864 - DNA, 19 bp, Artificial Sequence
  Synthetic construct
ccattccgtcatctctccc

SEQ ID NO: 865 - DNA, 21 bp, Artificial Sequence
  Synthetic construct
accattccgtcatctctccca

SEQ ID NO: 866 - DNA, 20 bp, Artificial Sequence
  Synthetic construct
accattccgtcatctctccc

SEQ ID NO: 867 - DNA, 19 bp, Artificial Sequence
  Synthetic construct
tcccagttccagccttgca

SEQ ID NO: 868 - DNA, 21 bp, Artificial Sequence
  Synthetic construct
ccattccgtcatctctcccaa

SEQ ID NO: 869 - DNA, 21 bp, Artificial Sequence
  Synthetic construct
tccaccattccgtcatctctc

SEQ ID NO: 870 - DNA, 21 bp, Artificial Sequence
  Synthetic construct
gccacatcttctccagggtct

SEQ ID NO: 871 - DNA, 20 bp, Artificial Sequence
  Synthetic construct
gccacatcttctccagggtc

SEQ ID NO: 872 - DNA, 21 bp, Artificial Sequence
  Synthetic construct
gtttgtagcatccagtcccac

SEQ ID NO: 873 - DNA, 19 bp, Artificial Sequence
  Synthetic construct
agcagttctctctccctct

SEQ ID NO: 874 - DNA, 19 bp, Artificial Sequence
  Synthetic construct
gccacatcttctccagggt

SEQ ID NO: 875 - DNA, 20 bp, Artificial Sequence
  Synthetic construct
tttgtagcatccagtcccac

SEQ ID NO: 876 - DNA, 20 bp, Artificial Sequence
  Synthetic construct
gcagttctctctccctctga

SEQ ID NO: 877 - DNA, 19 bp, Artificial Sequence
  Synthetic construct
ttgtagcatccagtcccac

SEQ ID NO: 878 - DNA, 21 bp, Artificial Sequence
  Synthetic construct
agcagttctctctccctctga

SEQ ID NO: 879 - DNA, 20 bp, Artificial Sequence
  Synthetic construct
agcagttctctctccctctg

SEQ ID NO: 880 - DNA, 21 bp, Artificial Sequence
  Synthetic construct
tcttccttcttgttccactca

SEQ ID NO: 881 - DNA, 20 bp, Artificial Sequence
  Synthetic construct
tcttccttcttgttccactc

SEQ ID NO: 882 - DNA, 21 bp, Artificial Sequence
  Synthetic construct
ttcttccttcttgttccactc

SEQ ID NO: 883 - DNA, 20 bp, Artificial Sequence
  Synthetic construct
cttccttcttgttccactca

SEQ ID NO: 884 - DNA, 21 bp, Artificial Sequence
  Synthetic construct
gttcttccttcttgttccact

SEQ ID NO: 885 - DNA, 19 bp, Artificial Sequence
  Synthetic construct
cttccttcttgttccactc

SEQ ID NO: 886 - DNA, 20 bp, Artificial Sequence
  Synthetic construct
gccagccaccaggatatcga

SEQ ID NO: 887 - DNA, 20 bp, Artificial Sequence
  Synthetic construct
agcaccacctccttgatcgg

SEQ ID NO: 888 - DNA, 20 bp, Artificial Sequence
  Synthetic construct
gttcttccttcttgttccac

SEQ ID NO: 889 - DNA, 19 bp, Artificial Sequence
  Synthetic construct
ttccttcttgttccactca

SEQ ID NO: 890 - DNA, 21 bp, Artificial Sequence
  Synthetic construct
ctcctcaatccagccagtgtc

SEQ ID NO: 891 - DNA, 19 bp, Artificial Sequence
  Synthetic construct
gaccttcccagcccatttc

SEQ ID NO: 892 - DNA, 20 bp, Artificial Sequence
  Synthetic construct
gaccttcccagcccatttct

SEQ ID NO: 893 - DNA, 20 bp, Artificial Sequence
  Synthetic construct
tttcctgtgtgtgtcctttc

SEQ ID NO: 894 - DNA, 19 bp, Artificial Sequence
  Synthetic construct
accttcccagcccatttct

SEQ ID NO: 895 - DNA, 20 bp, Artificial Sequence
  Synthetic construct
ctcctcaatccagccagtgt

SEQ ID NO: 896 - DNA, 19 bp, Artificial Sequence
  Synthetic construct
ttcctgtgtgtgtcctttc

SEQ ID NO: 897 - DNA, 20 bp, Artificial Sequence
  Synthetic construct
tcctcaatccagccagtgtc

SEQ ID NO: 898 - DNA, 20 bp, Artificial Sequence
  Synthetic construct
tcctgtgtgtgtcctttcgc

SEQ ID NO: 899 - DNA, 21 bp, Artificial Sequence
  Synthetic construct
tctactcctcaatccagccag

SEQ ID NO: 900 - DNA, 20 bp, Artificial Sequence
  Synthetic construct
gtccttcctcactacagccc

SEQ ID NO: 901 - DNA, 21 bp, Artificial Sequence
  Synthetic construct
gtccttcctcactacagccca

SEQ ID NO: 902 - DNA, 20 bp, Artificial Sequence
  Synthetic construct
gccactgctatgttctccca

SEQ ID NO: 903 - DNA, 20 bp, Artificial Sequence
  Synthetic construct
tccttccaccacactgcctt

SEQ ID NO: 904 - DNA, 21 bp, Artificial Sequence
  Synthetic construct
gccactgctatgttctcccat

SEQ ID NO: 905 - DNA, 19 bp, Artificial Sequence
  Synthetic construct
gccactgctatgttctccc

SEQ ID NO: 906 - DNA, 20 bp, Artificial Sequence
  Synthetic construct
atccttccaccacactgcct

SEQ ID NO: 907 - DNA, 19 bp, Artificial Sequence
  Synthetic construct
tccttccaccacactgcct

SEQ ID NO: 908 - DNA, 20 bp, Artificial Sequence
  Synthetic construct
tccttcctcactacagccca

SEQ ID NO: 909 - DNA, 21 bp, Artificial Sequence
  Synthetic construct
tccttcctcactacagcccag

SEQ ID NO: 910 - DNA, 20 bp, Artificial Sequence
  Synthetic construct
ttcccaccctcttccactcc

SEQ ID NO: 911 - DNA, 20 bp, Artificial Sequence
  Synthetic construct
cttcccaccctcttccactc

SEQ ID NO: 912 - DNA, 20 bp, Artificial Sequence
  Synthetic construct
ccctcttccactcccaacct

SEQ ID NO: 913 - DNA, 19 bp, Artificial Sequence
  Synthetic construct
ttcccaccctcttccactc

SEQ ID NO: 914 - DNA, 21 bp, Artificial Sequence
  Synthetic construct
accctcttccactcccaacct

SEQ ID NO: 915 - DNA, 20 bp, Artificial Sequence
  Synthetic construct
ccaccctcttccactcccaa

SEQ ID NO: 916 - DNA, 21 bp, Artificial Sequence
  Synthetic construct
cctcttccactcccaacctct

SEQ ID NO: 917 - DNA, 20 bp, Artificial Sequence
  Synthetic construct
accctcttccactcccaacc

SEQ ID NO: 918 - DNA, 20 bp, Artificial Sequence
  Synthetic construct
cctcttccactcccaacctc

SEQ ID NO: 919 - DNA, 19 bp, Artificial Sequence
  Synthetic construct
cttcccaccctcttccact

SEQ ID NO: 920 - DNA, 20 bp, Artificial Sequence
  Synthetic construct
ccttctcttgtcctgccacc

SEQ ID NO: 921 - DNA, 21 bp, Artificial Sequence
  Synthetic construct
ccttctcttgtcctgccacca

SEQ ID NO: 922 - DNA, 20 bp, Artificial Sequence
  Synthetic construct
cttctcttgtcctgccacca

SEQ ID NO: 923 - DNA, 20 bp, Artificial Sequence
  Synthetic construct
gccttctcttgtcctgccac

SEQ ID NO: 924 - DNA, 19 bp, Artificial Sequence
  Synthetic construct
cttctcttgtcctgccacc

SEQ ID NO: 925 - DNA, 19 bp, Artificial Sequence
  Synthetic construct
ccttctcttgtcctgccac

SEQ ID NO: 926 - DNA, 21 bp, Artificial Sequence
  Synthetic construct
tgccttctcttgtcctgccac

SEQ ID NO: 927 - DNA, 19 bp, Artificial Sequence
  Synthetic construct
ttctcttgtcctgccacca

SEQ ID NO: 928 - DNA, 21 bp, Artificial Sequence
  Synthetic construct
cttctcttgtcctgccaccac

SEQ ID NO: 929 - DNA, 20 bp, Artificial Sequence
  Synthetic construct
tctcttgtcctgccaccact

SEQ ID NO: 930 - DNA, 21 bp, Artificial Sequence
  Synthetic construct
cctcttgttagccctccacct

SEQ ID NO: 931 - DNA, 21 bp, Artificial Sequence
  Synthetic construct
tcctcttgttagccctccacc

SEQ ID NO: 932 - DNA, 20 bp, Artificial Sequence
  Synthetic construct
gtcctcctccttcagcccat

SEQ ID NO: 933 - DNA, 20 bp, Artificial Sequence
  Synthetic construct
cctcttgttagccctccacc

SEQ ID NO: 934 - DNA, 21 bp, Artificial Sequence
  Synthetic construct
ctcttgttagccctccacctc

SEQ ID NO: 935 - DNA, 21 bp, Artificial Sequence
  Synthetic construct
gtcctcctccttcagcccatt

SEQ ID NO: 936 - DNA, 19 bp, Artificial Sequence
  Synthetic construct
ctctttgtcctcctccttc

SEQ ID NO: 937 - DNA, 20 bp, Artificial Sequence
  Synthetic construct
ttgtcctcctccttcagccc

SEQ ID NO: 938 - DNA, 20 bp, Artificial Sequence
  Synthetic construct
gctctttgtcctcctccttc

SEQ ID NO: 939 - DNA, 20 bp, Artificial Sequence
  Synthetic construct
ctcttgttagccctccacct

SEQ ID NO: 940 - DNA, 20 bp, Artificial Sequence
  Synthetic construct
ctgctttcccttctctgttg

SEQ ID NO: 941 - DNA, 21 bp, Artificial Sequence
  Synthetic construct
tcccttctctgttggttggct

SEQ ID NO: 942 - DNA, 19 bp, Artificial Sequence
  Synthetic construct
ctgctttcccttctctgtt

SEQ ID NO: 943 - DNA, 21 bp, Artificial Sequence
  Synthetic construct
ctgctttcccttctctgttgg

SEQ ID NO: 944 - DNA, 20 bp, Artificial Sequence
  Synthetic construct
tcccttctctgttggttggc

SEQ ID NO: 945 - DNA, 21 bp, Artificial Sequence
  Synthetic construct
cccttctctgttggttggctc

SEQ ID NO: 946 - DNA, 21 bp, Artificial Sequence
  Synthetic construct
ttcccttctctgttggttggc

SEQ ID NO: 947 - DNA, 20 bp, Artificial Sequence
  Synthetic construct
gctttcccttctctgttggt

SEQ ID NO: 948 - DNA, 21 bp, Artificial Sequence
  Synthetic construct
gctttcccttctctgttggtt

SEQ ID NO: 949 - DNA, 21 bp, Artificial Sequence
  Synthetic construct
tctctgttggttggctcttct

SEQ ID NO: 950 - DNA, 20 bp, Artificial Sequence
  Synthetic construct
gcgtctccacatcccagttt

SEQ ID NO: 951 - DNA, 19 bp, Artificial Sequence
  Synthetic construct
gcgtctccacatcccagtt

SEQ ID NO: 952 - DNA, 20 bp, Artificial Sequence
  Synthetic construct
gttcgtgcggtccctgtagt

SEQ ID NO: 953 - DNA, 20 bp, Artificial Sequence
  Synthetic construct
accagcgtctccacatccca

SEQ ID NO: 954 - DNA, 21 bp, Artificial Sequence
  Synthetic construct
gttcgtgcggtccctgtagtt

SEQ ID NO: 955 - DNA, 20 bp, Artificial Sequence
  Synthetic construct
cagcgtctccacatcccagt

SEQ ID NO: 956 - DNA, 21 bp, Artificial Sequence
  Synthetic construct
tgttcgtgcggtccctgtagt

SEQ ID NO: 957 - DNA, 19 bp, Artificial Sequence
  Synthetic construct
cgtctccacatcccagttt

SEQ ID NO: 958 - DNA, 21 bp, Artificial Sequence
  Synthetic construct
cagcgtctccacatcccagtt

SEQ ID NO: 959 - DNA, 21 bp, Artificial Sequence
  Synthetic construct
taccagcgtctccacatccca

SEQ ID NO: 960 - DNA, 21 bp, Artificial Sequence
  Synthetic construct
gtcttcctgccgtttctctgt

SEQ ID NO: 961 - DNA, 20 bp, Artificial Sequence
  Synthetic construct
gtcttcctgccgtttctctg

SEQ ID NO: 962 - DNA, 19 bp, Artificial Sequence
  Synthetic construct
gtcttcctgccgtttctct

SEQ ID NO: 963 - DNA, 20 bp, Artificial Sequence
  Synthetic construct
tcttcctgccgtttctctgt

SEQ ID NO: 964 - DNA, 20 bp, Artificial Sequence
  Synthetic construct
gatcgtccttagccagtcca

SEQ ID NO: 965 - DNA, 21 bp, Artificial Sequence
  Synthetic construct
tcttcctgccgtttctctgtt

SEQ ID NO: 966 - DNA, 21 bp, Artificial Sequence
  Synthetic construct
gggtcttcctgccgtttctct

SEQ ID NO: 967 - DNA, 19 bp, Artificial Sequence
  Synthetic construct
atcgtccttagccagtcca

SEQ ID NO: 968 - DNA, 21 bp, Artificial Sequence
  Synthetic construct
gtccttagccagtccaatctc

SEQ ID NO: 969 - DNA, 20 bp, Artificial Sequence
  Synthetic construct
cttcctgccgtttctctgtt

SEQ ID NO: 970 - DNA, 20 bp, Artificial Sequence
  Synthetic construct
ctttcacctccctctctcca

SEQ ID NO: 971 - DNA, 19 bp, Artificial Sequence
  Synthetic construct
ctttcacctccctctctcc

SEQ ID NO: 972 - DNA, 20 bp, Artificial Sequence
  Synthetic construct
gctttcacctccctctctcc

SEQ ID NO: 973 - DNA, 21 bp, Artificial Sequence
  Synthetic construct
gctttcacctccctctctcca

SEQ ID NO: 974 - DNA, 19 bp, Artificial Sequence
  Synthetic construct
tttcacctccctctctcca

SEQ ID NO: 975 - DNA, 21 bp, Artificial Sequence
  Synthetic construct
ccatctcactcactcactccc

SEQ ID NO: 976 - DNA, 21 bp, Artificial Sequence
  Synthetic construct
ctttcacctccctctctccag

SEQ ID NO: 977 - DNA, 20 bp, Artificial Sequence
  Synthetic construct
tcactcactcccagcatccc

SEQ ID NO: 978 - DNA, 20 bp, Artificial Sequence
  Synthetic construct
gttcccacacagcatctccc

SEQ ID NO: 979 - DNA, 21 bp, Artificial Sequence
  Synthetic construct
gttcccacacagcatctccca

SEQ ID NO: 980 - DNA, 20 bp, Artificial Sequence
  Synthetic construct
gatgtcgtccctctctgtga

SEQ ID NO: 981 - DNA, 19 bp, Artificial Sequence
  Synthetic construct
gatgtcgtccctctctgtg

SEQ ID NO: 982 - DNA, 19 bp, Artificial Sequence
  Synthetic construct
atgtcgtccctctctgtga

SEQ ID NO: 983 - DNA, 20 bp, Artificial Sequence
  Synthetic construct
gctgcccttgtactccatct

SEQ ID NO: 984 - DNA, 20 bp, Artificial Sequence
  Synthetic construct
ctgcccttgtactccatctt

SEQ ID NO: 985 - DNA, 21 bp, Artificial Sequence
  Synthetic construct
ctgcccttgtactccatcttg

SEQ ID NO: 986 - DNA, 21 bp, Artificial Sequence
  Synthetic construct
ctgctgcccttgtactccatc

SEQ ID NO: 987 - DNA, 19 bp, Artificial Sequence
  Synthetic construct
ctgcccttgtactccatct

SEQ ID NO: 988 - DNA, 21 bp, Artificial Sequence
  Synthetic construct
gctgcccttgtactccatctt

SEQ ID NO: 989 - DNA, 20 bp, Artificial Sequence
  Synthetic construct
gggcttgtccaccagtgagt

SEQ ID NO: 990 - DNA, 20 bp, Artificial Sequence
  Synthetic construct
cccaaccctgtgctctctga

SEQ ID NO: 991 - DNA, 21 bp, Artificial Sequence
  Synthetic construct
cccaaccctgtgctctctgaa

SEQ ID NO: 992 - DNA, 19 bp, Artificial Sequence
  Synthetic construct
ccaaccctgtgctctctga

SEQ ID NO: 993 - DNA, 21 bp, Artificial Sequence
  Synthetic construct
ggatggttgccgtgtctgtgt

SEQ ID NO: 994 - DNA, 20 bp, Artificial Sequence
  Synthetic construct
ccaaccctgtgctctctgaa

SEQ ID NO: 995 - DNA, 20 bp, Artificial Sequence
  Synthetic construct
gttgatctgtgaccttaccc

SEQ ID NO: 996 - DNA, 20 bp, Artificial Sequence
  Synthetic construct
gatggttgccgtgtctgtgt

SEQ ID NO: 997 - DNA, 20 bp, Artificial Sequence
  Synthetic construct
ggttgccgtgtctgtgtaga

SEQ ID NO: 998 - DNA, 21 bp, Artificial Sequence
  Synthetic construct
tgttgatctgtgaccttaccc

SEQ ID NO: 999 - DNA, 20 bp, Artificial Sequence
  Synthetic construct
ggatggttgccgtgtctgtg

SEQ ID NO: 1000 - DNA, 21 bp, Artificial Sequence
  Synthetic construct
ctcagcatgttccctctcctc

SEQ ID NO: 1001 - DNA, 21 bp, Artificial Sequence
  Synthetic construct
tctcagcatgttccctctcct

SEQ ID NO: 1002 - DNA, 20 bp, Artificial Sequence
  Synthetic construct
ccgctctcccagtcatcaca

SEQ ID NO: 1003 - DNA, 20 bp, Artificial Sequence
  Synthetic construct
ctcagcatgttccctctcct

SEQ ID NO: 1004 - DNA, 20 bp, Artificial Sequence
  Synthetic construct
tcagcatgttccctctcctc

SEQ ID NO: 1005 - DNA, 20 bp, Artificial Sequence
  Synthetic construct
tctcagcatgttccctctcc

SEQ ID NO: 1006 - DNA, 21 bp, Artificial Sequence
  Synthetic construct
tcagcatgttccctctcctca

SEQ ID NO: 1007 - DNA, 21 bp, Artificial Sequence
  Synthetic construct
ttctcagcatgttccctctcc

SEQ ID NO: 1008 - DNA, 20 bp, Artificial Sequence
  Synthetic construct
cagcatgttccctctcctca

SEQ ID NO: 1009 - DNA, 21 bp, Artificial Sequence
  Synthetic construct
gctctcccagtcatcacagtc

SEQ ID NO: 1010 - DNA, 21 bp, Artificial Sequence
  Synthetic construct
tcctcttcaccacaccctcct

SEQ ID NO: 1011 - DNA, 20 bp, Artificial Sequence
  Synthetic construct
ccacctgctcctctcccatt

SEQ ID NO: 1012 - DNA, 20 bp, Artificial Sequence
  Synthetic construct
cctcttcaccacaccctcct

SEQ ID NO: 1013 - DNA, 20 bp, Artificial Sequence
  Synthetic construct
cctcctcttcaccacaccct

SEQ ID NO: 1014 - DNA, 20 bp, Artificial Sequence
  Synthetic construct
tcctcttcaccacaccctcc

SEQ ID NO: 1015 - DNA, 20 bp, Artificial Sequence
  Synthetic construct
ctcctcctcctcctgttcct

SEQ ID NO: 1016 - DNA, 20 bp, Artificial Sequence
  Synthetic construct
ctcctcctcctcctcctgtt

SEQ ID NO: 1017 - DNA, 20 bp, Artificial Sequence
  Synthetic construct
tcctcctcctcctgttcctc

SEQ ID NO: 1018 - DNA, 20 bp, Artificial Sequence
  Synthetic construct
tcctcctcctcctcctgttc

SEQ ID NO: 1019 - DNA, 21 bp, Artificial Sequence
  Synthetic construct
ccacctgctcctctcccattt

SEQ ID NO: 1020 - DNA, 19 bp, Artificial Sequence
  Synthetic construct
atactcctcaccacctcct

SEQ ID NO: 1021 - DNA, 20 bp, Artificial Sequence
  Synthetic construct
atactcctcaccacctcctg

SEQ ID NO: 1022 - DNA, 19 bp, Artificial Sequence
  Synthetic construct
tactcctcaccacctcctg

SEQ ID NO: 1023 - DNA, 20 bp, Artificial Sequence
  Synthetic construct
gatactcctcaccacctcct

SEQ ID NO: 1024 - DNA, 21 bp, Artificial Sequence
  Synthetic construct
gatactcctcaccacctcctg

SEQ ID NO: 1025 - DNA, 19 bp, Artificial Sequence
  Synthetic construct
actcctcaccacctcctgt

SEQ ID NO: 1026 - DNA, 20 bp, Artificial Sequence
  Synthetic construct
tactcctcaccacctcctgt

SEQ ID NO: 1027 - DNA, 19 bp, Artificial Sequence
  Synthetic construct
gatactcctcaccacctcc

SEQ ID NO: 1028 - DNA, 21 bp, Artificial Sequence
  Synthetic construct
atactcctcaccacctcctgt

SEQ ID NO: 1029 - DNA, 21 bp, Artificial Sequence
  Synthetic construct
agatactcctcaccacctcct

SEQ ID NO: 1030 - DNA, 21 bp, Artificial Sequence
  Synthetic construct
gttccaccttcttgttctccc

SEQ ID NO: 1031 - DNA, 20 bp, Artificial Sequence
  Synthetic construct
ttccaagtcccgcagccaca

SEQ ID NO: 1032 - DNA, 21 bp, Artificial Sequence
  Synthetic construct
tttccaagtcccgcagccaca

SEQ ID NO: 1033 - DNA, 20 bp, Artificial Sequence
  Synthetic construct
tttccaagtcccgcagccac

SEQ ID NO: 1034 - DNA, 21 bp, Artificial Sequence
  Synthetic construct
atttccaagtcccgcagccac

SEQ ID NO: 1035 - DNA, 20 bp, Artificial Sequence
  Synthetic construct
ttccaccttcttgttctccc

SEQ ID NO: 1036 - DNA, 20 bp, Artificial Sequence
  Synthetic construct
tccaccttcttgttctcccg

SEQ ID NO: 1037 - DNA, 19 bp, Artificial Sequence
  Synthetic construct
tccaccttcttgttctccc

SEQ ID NO: 1038 - DNA, 21 bp, Artificial Sequence
  Synthetic construct
ttccaccttcttgttctcccg

SEQ ID NO: 1039 - DNA, 20 bp, Artificial Sequence
  Synthetic construct
tccaagtcccgcagccacaa

SEQ ID NO: 1040 - DNA, 21 bp, Artificial Sequence
  Synthetic construct
cttgccactgaagaactactg

SEQ ID NO: 1041 - DNA, 21 bp, Artificial Sequence
  Synthetic construct
gcagagggcaacagttcttca

SEQ ID NO: 1042 - DNA, 21 bp, Artificial Sequence
  Synthetic construct
ggcagagggcaacagttcttc

SEQ ID NO: 1043 - DNA, 21 bp, Artificial Sequence
  Synthetic construct
gcttgccactgaagaactact

SEQ ID NO: 1044 - DNA, 20 bp, Artificial Sequence
  Synthetic construct
cttgccactgaagaactact

SEQ ID NO: 1045 - DNA, 20 bp, Artificial Sequence
  Synthetic construct
gctttagctgggtcaggaca

SEQ ID NO: 1046 - DNA, 20 bp, Artificial Sequence
  Synthetic construct
gcagagggcaacagttcttc

SEQ ID NO: 1047 - DNA, 21 bp, Artificial Sequence
  Synthetic construct
gctttagctgggtcaggacat

SEQ ID NO: 1048 - DNA, 20 bp, Artificial Sequence
  Synthetic construct
ctttagctgggtcaggacat

SEQ ID NO: 1049 - DNA, 19 bp, Artificial Sequence
  Synthetic construct
ctttagctgggtcaggaca

SEQ ID NO: 1050 - DNA, 20 bp, Artificial Sequence
  Synthetic construct
gctcatccacttcctcatct

SEQ ID NO: 1051 - DNA, 21 bp, Artificial Sequence
  Synthetic construct
gctcatccacttcctcatctg

SEQ ID NO: 1052 - DNA, 20 bp, Artificial Sequence
  Synthetic construct
atcacaccaccctgctaccc

SEQ ID NO: 1053 - DNA, 21 bp, Artificial Sequence
  Synthetic construct
cttggtcttggtctttgttct

SEQ ID NO: 1054 - DNA, 21 bp, Artificial Sequence
  Synthetic construct
cttcttggtcttggtctttgt

SEQ ID NO: 1055 - DNA, 20 bp, Artificial Sequence
  Synthetic construct
tcacaccaccctgctaccca

SEQ ID NO: 1056 - DNA, 21 bp, Artificial Sequence
  Synthetic construct
tcttggtcttggtctttgttc

SEQ ID NO: 1057 - DNA, 19 bp, Artificial Sequence
  Synthetic construct
gctcatccacttcctcatc

SEQ ID NO: 1058 - DNA, 20 bp, Artificial Sequence
  Synthetic construct
ctcatccacttcctcatctg

SEQ ID NO: 1059 - DNA, 21 bp, Artificial Sequence
  Synthetic construct
atcacaccaccctgctaccca

SEQ ID NO: 1060 - DNA, 21 bp, Artificial Sequence
  Synthetic construct
cctcatctccttcttcttccc

SEQ ID NO: 1061 - DNA, 20 bp, Artificial Sequence
  Synthetic construct
ctcatctccttcttcttccc

SEQ ID NO: 1062 - DNA, 21 bp, Artificial Sequence
  Synthetic construct
gtcccttgtgtttctgcttct

SEQ ID NO: 1063 - DNA, 20 bp, Artificial Sequence
  Synthetic construct
gtcccttgtgtttctgcttc

SEQ ID NO: 1064 - DNA, 21 bp, Artificial Sequence
  Synthetic construct
cgtcccttgtgtttctgcttc

SEQ ID NO: 1065 - DNA, 19 bp, Artificial Sequence
  Synthetic construct
tcatctccttcttcttccc

SEQ ID NO: 1066 - DNA, 21 bp, Artificial Sequence
  Synthetic construct
cccttcctcatccgcttcttc

SEQ ID NO: 1067 - DNA, 21 bp, Artificial Sequence
  Synthetic construct
tcctcatctccttcttcttcc

SEQ ID NO: 1068 - DNA, 20 bp, Artificial Sequence
  Synthetic construct
cctcatctccttcttcttcc

SEQ ID NO: 1069 - DNA, 20 bp, Artificial Sequence
  Synthetic construct
cgtcccttgtgtttctgctt

SEQ ID NO: 1070 - DNA, 21 bp, Artificial Sequence
  Synthetic construct
tcttcacagccctcttccacc

SEQ ID NO: 1071 - DNA, 20 bp, Artificial Sequence
  Synthetic construct
cttcacagccctcttccacc

SEQ ID NO: 1072 - DNA, 21 bp, Artificial Sequence
  Synthetic construct
cttcacagccctcttccacca

SEQ ID NO: 1073 - DNA, 20 bp, Artificial Sequence
  Synthetic construct
tcacagccctcttccaccag

SEQ ID NO: 1074 - DNA, 20 bp, Artificial Sequence
  Synthetic construct
ttcacagccctcttccacca

SEQ ID NO: 1075 - DNA, 21 bp, Artificial Sequence
  Synthetic construct
ttcacagccctcttccaccag

SEQ ID NO: 1076 - DNA, 19 bp, Artificial Sequence
  Synthetic construct
tcacagccctcttccacca

SEQ ID NO: 1077 - DNA, 20 bp, Artificial Sequence
  Synthetic construct
tcttcacagccctcttccac

SEQ ID NO: 1078 - DNA, 19 bp, Artificial Sequence
  Synthetic construct
ttcacagccctcttccacc

SEQ ID NO: 1079 - DNA, 21 bp, Artificial Sequence
  Synthetic construct
atcttcacagccctcttccac

SEQ ID NO: 1080 - DNA, 20 bp, Artificial Sequence
  Synthetic construct
tcctcttactcccgccatct

SEQ ID NO: 1081 - DNA, 21 bp, Artificial Sequence
  Synthetic construct
ttcctcttactcccgccatct

SEQ ID NO: 1082 - DNA, 20 bp, Artificial Sequence
  Synthetic construct
ttcctcttactcccgccatc

SEQ ID NO: 1083 - DNA, 21 bp, Artificial Sequence
  Synthetic construct
tcctcttactcccgccatcta

SEQ ID NO: 1084 - DNA, 19 bp, Artificial Sequence
  Synthetic construct
cctcttactcccgccatct

SEQ ID NO: 1085 - DNA, 19 bp, Artificial Sequence
  Synthetic construct
tcctcttactcccgccatc

SEQ ID NO: 1086 - DNA, 21 bp, Artificial Sequence
  Synthetic construct
tttcctcttactcccgccatc

SEQ ID NO: 1087 - DNA, 20 bp, Artificial Sequence
  Synthetic construct
cctcttactcccgccatcta

SEQ ID NO: 1088 - DNA, 20 bp, Artificial Sequence
  Synthetic construct
tttcctcttactcccgccat

SEQ ID NO: 1089 - DNA, 19 bp, Artificial Sequence
  Synthetic construct
tttcctcttactcccgcca

SEQ ID NO: 1090 - DNA, 20 bp, Artificial Sequence
  Synthetic construct
ccgctgcttccctgtactca

SEQ ID NO: 1091 - DNA, 20 bp, Artificial Sequence
  Synthetic construct
gctgcttccctgtactcaca

SEQ ID NO: 1092 - DNA, 21 bp, Artificial Sequence
  Synthetic construct
cgctgcttccctgtactcaca

SEQ ID NO: 1093 - DNA, 20 bp, Artificial Sequence
  Synthetic construct
cgctgcttccctgtactcac

SEQ ID NO: 1094 - DNA, 19 bp, Artificial Sequence
  Synthetic construct
gctgcttccctgtactcac

SEQ ID NO: 1095 - DNA, 19 bp, Artificial Sequence
  Synthetic construct
cgctgcttccctgtactca

SEQ ID NO: 1096 - DNA, 20 bp, Artificial Sequence
  Synthetic construct
ctccgtcgcctctctttgct

SEQ ID NO: 1097 - DNA, 21 bp, Artificial Sequence
  Synthetic construct
ctctgtctctacttcgcttcc

SEQ ID NO: 1098 - DNA, 21 bp, Artificial Sequence
  Synthetic construct
ccgtcgcctctctttgcttct

SEQ ID NO: 1099 - DNA, 21 bp, Artificial Sequence
  Synthetic construct
ctccgtcgcctctctttgctt

SEQ ID NO: 1100 - DNA, 20 bp, Artificial Sequence
  Synthetic construct
aaaccctccaccctctctcc

SEQ ID NO: 1101 - DNA, 21 bp, Artificial Sequence
  Synthetic construct
actctgtccctccctcaatcc

SEQ ID NO: 1102 - DNA, 20 bp, Artificial Sequence
  Synthetic construct
ctctgtccctccctcaatcc

SEQ ID NO: 1103 - DNA, 20 bp, Artificial Sequence
  Synthetic construct
tctgtccctccctcaatccc

SEQ ID NO: 1104 - DNA, 19 bp, Artificial Sequence
  Synthetic construct
aaaccctccaccctctctc

SEQ ID NO: 1105 - DNA, 21 bp, Artificial Sequence
  Synthetic construct
cactctgtccctccctcaatc

SEQ ID NO: 1106 - DNA, 20 bp, Artificial Sequence
  Synthetic construct
actctgtccctccctcaatc

SEQ ID NO: 1107 - DNA, 20 bp, Artificial Sequence
  Synthetic construct
tctcctcagcaccctctcca

SEQ ID NO: 1108 - DNA, 20 bp, Artificial Sequence
  Synthetic construct
cactctgtccctccctcaat

SEQ ID NO: 1109 - DNA, 20 bp, Artificial Sequence
  Synthetic construct
ttctcctcagcaccctctcc

SEQ ID NO: 1110 - DNA, 20 bp, Artificial Sequence
  Synthetic construct
cattcgcttcttcctccact

SEQ ID NO: 1111 - DNA, 21 bp, Artificial Sequence
  Synthetic construct
cattcgcttcttcctccactt

SEQ ID NO: 1112 - DNA, 20 bp, Artificial Sequence
  Synthetic construct
ttcgcttcttcctccacttg

SEQ ID NO: 1113 - DNA, 21 bp, Artificial Sequence
  Synthetic construct
cctctgcctcatctttcttct

SEQ ID NO: 1114 - DNA, 20 bp, Artificial Sequence
  Synthetic construct
attcgcttcttcctccactt

SEQ ID NO: 1115 - DNA, 21 bp, Artificial Sequence
  Synthetic construct
attcgcttcttcctccacttg

SEQ ID NO: 1116 - DNA, 19 bp, Artificial Sequence
  Synthetic construct
tcgcttcttcctccacttg

SEQ ID NO: 1117 - DNA, 19 bp, Artificial Sequence
  Synthetic construct
ttcgcttcttcctccactt

SEQ ID NO: 1118 - DNA, 19 bp, Artificial Sequence
  Synthetic construct
attcgcttcttcctccact

SEQ ID NO: 1119 - DNA, 20 bp, Artificial Sequence
  Synthetic construct
cctctgcctcatctttcttc

SEQ ID NO: 1120 - DNA, 20 bp, Artificial Sequence
  Synthetic construct
gccattctcatccaccttat

SEQ ID NO: 1121 - DNA, 20 bp, Artificial Sequence
  Synthetic construct
ttgccattctcatccacctt

SEQ ID NO: 1122 - DNA, 20 bp, Artificial Sequence
  Synthetic construct
tttgccattctcatccacct

SEQ ID NO: 1123 - DNA, 19 bp, Artificial Sequence
  Synthetic construct
gccattctcatccacctta

SEQ ID NO: 1124 - DNA, 21 bp, Artificial Sequence
  Synthetic construct
tttgccattctcatccacctt

SEQ ID NO: 1125 - DNA, 19 bp, Artificial Sequence
  Synthetic construct
tgccattctcatccacctt

SEQ ID NO: 1126 - DNA, 19 bp, Artificial Sequence
  Synthetic construct
ttgccattctcatccacct

SEQ ID NO: 1127 - DNA, 21 bp, Artificial Sequence
  Synthetic construct
gccattctcatccaccttata

SEQ ID NO: 1128 - DNA, 20 bp, Artificial Sequence
  Synthetic construct
tgccattctcatccacctta

SEQ ID NO: 1129 - DNA, 21 bp, Artificial Sequence
  Synthetic construct
ttgccattctcatccacctta

SEQ ID NO: 1130 - DNA, 21 bp, Artificial Sequence
  Synthetic construct
ctccctctcattgtccagtcc

SEQ ID NO: 1131 - DNA, 20 bp, Artificial Sequence
  Synthetic construct
ggtctggctctctctctctc

SEQ ID NO: 1132 - DNA, 20 bp, Artificial Sequence
  Synthetic construct
tccctctcattgtccagtcc

SEQ ID NO: 1133 - DNA, 21 bp, Artificial Sequence
  Synthetic construct
tccctctcattgtccagtcca

SEQ ID NO: 1134 - DNA, 21 bp, Artificial Sequence
  Synthetic construct
ccctctcattgtccagtccac

SEQ ID NO: 1135 - DNA, 21 bp, Artificial Sequence
  Synthetic construct
tctccctctcattgtccagtc

SEQ ID NO: 1136 - DNA, 21 bp, Artificial Sequence
  Synthetic construct
ggtctggctctctctctctca

SEQ ID NO: 1137 - DNA, 20 bp, Artificial Sequence
  Synthetic construct
ctccctctcattgtccagtc

SEQ ID NO: 1138 - DNA, 20 bp, Artificial Sequence
  Synthetic construct
tctccctctcattgtccagt

SEQ ID NO: 1139 - DNA, 19 bp, Artificial Sequence
  Synthetic construct
ggtctggctctctctctct

SEQ ID NO: 1140 - DNA, 20 bp, Artificial Sequence
  Synthetic construct
aaaccctccaccctctctcc

SEQ ID NO: 1141 - DNA, 21 bp, Artificial Sequence
  Synthetic construct
actctgtccctccctcaatcc

SEQ ID NO: 1142 - DNA, 20 bp, Artificial Sequence
  Synthetic construct
ctctgtccctccctcaatcc

SEQ ID NO: 1143 - DNA, 20 bp, Artificial Sequence
  Synthetic construct
tctgtccctccctcaatccc

SEQ ID NO: 1144 - DNA, 19 bp, Artificial Sequence
  Synthetic construct
aaaccctccaccctctctc

SEQ ID NO: 1145 - DNA, 21 bp, Artificial Sequence
  Synthetic construct
ctctctctgctgtcttcctcc

SEQ ID NO: 1146 - DNA, 21 bp, Artificial Sequence
  Synthetic construct
cactctgtccctccctcaatc

SEQ ID NO: 1147 - DNA, 20 bp, Artificial Sequence
  Synthetic construct
actctgtccctccctcaatc

SEQ ID NO: 1148 - DNA, 20 bp, Artificial Sequence
  Synthetic construct
tctcctcagcaccctctcca

SEQ ID NO: 1149 - DNA, 20 bp, Artificial Sequence
  Synthetic construct
tctctctgctgtcttcctcc

SEQ ID NO: 1150 - DNA, 20 bp, Artificial Sequence
  Synthetic construct
ccctacgccacttggacaga

SEQ ID NO: 1151 - DNA, 19 bp, Artificial Sequence
  Synthetic construct
cctgcatggtttgtctccc

SEQ ID NO: 1152 - DNA, 20 bp, Artificial Sequence
  Synthetic construct
tacgccacttggacagagcc

SEQ ID NO: 1153 - DNA, 20 bp, Artificial Sequence
  Synthetic construct
ctacgccacttggacagagc

SEQ ID NO: 1154 - DNA, 20 bp, Artificial Sequence
  Synthetic construct
cctacgccacttggacagag

SEQ ID NO: 1155 - DNA, 21 bp, Artificial Sequence
  Synthetic construct
ggactctgggaagctgtagga

SEQ ID NO: 1156 - DNA, 19 bp, Artificial Sequence
  Synthetic construct
cctacgccacttggacaga

SEQ ID NO: 1157 - DNA, 21 bp, Artificial Sequence
  Synthetic construct
aggactctgggaagctgtagg

SEQ ID NO: 1158 - DNA, 20 bp, Artificial Sequence
  Synthetic construct
ggactctgggaagctgtagg

SEQ ID NO: 1159 - DNA, 19 bp, Artificial Sequence
  Synthetic construct
tacgccacttggacagagc

SEQ ID NO: 1160 - DNA, 21 bp, Artificial Sequence
  Synthetic construct
ctctctctctccactctctcc

SEQ ID NO: 1161 - DNA, 20 bp, Artificial Sequence
  Synthetic construct
tctctctctccactctctcc

SEQ ID NO: 1162 - DNA, 21 bp, Artificial Sequence
  Synthetic construct
tctctctctctccactctctc

SEQ ID NO: 1163 - DNA, 20 bp, Artificial Sequence
  Synthetic construct
ctctctctctccactctctc

SEQ ID NO: 1164 - DNA, 19 bp, Artificial Sequence
  Synthetic construct
ctctctctccactctctcc

SEQ ID NO: 1165 - DNA, 20 bp, Artificial Sequence
  Synthetic construct
tctctctctctccactctct

SEQ ID NO: 1166 - DNA, 21 bp, Artificial Sequence
  Synthetic construct
gtctctctctctccactctct

SEQ ID NO: 1167 - DNA, 21 bp, Artificial Sequence
  Synthetic construct
gcgtctctctctctccactct

SEQ ID NO: 1168 - DNA, 20 bp, Artificial Sequence
  Synthetic construct
ttcactccctgcctcctcct

SEQ ID NO: 1169 - DNA, 19 bp, Artificial Sequence
  Synthetic construct
ctctctctctccactctct

SEQ ID NO: 1170 - DNA, 21 bp, Artificial Sequence
  Synthetic construct
ccacatccctctcaatcacct

SEQ ID NO: 1171 - DNA, 21 bp, Artificial Sequence
  Synthetic construct
gcacacatccatccacatccc

SEQ ID NO: 1172 - DNA, 20 bp, Artificial Sequence
  Synthetic construct
ccacatccctctcaatcacc

SEQ ID NO: 1173 - DNA, 21 bp, Artificial Sequence
  Synthetic construct
accacatccctctcaatcacc

SEQ ID NO: 1174 - DNA, 21 bp, Artificial Sequence
  Synthetic construct
tccctctcaatcacctccagc

SEQ ID NO: 1175 - DNA, 19 bp, Artificial Sequence
  Synthetic construct
ccttgtcccttcttatccc

SEQ ID NO: 1176 - DNA, 21 bp, Artificial Sequence
  Synthetic construct
cacacatccatccacatccca

SEQ ID NO: 1177 - DNA, 21 bp, Artificial Sequence
  Synthetic construct
ccactaaccacatccctctca

SEQ ID NO: 1178 - DNA, 20 bp, Artificial Sequence
  Synthetic construct
cacacatccatccacatccc

SEQ ID NO: 1179 - DNA, 19 bp, Artificial Sequence
  Synthetic construct
tccctctcaatcacctcca

SEQ ID NO: 1180 - DNA, 21 bp, Artificial Sequence
  Synthetic construct
gttctagttctctctctccct

SEQ ID NO: 1181 - DNA, 20 bp, Artificial Sequence
  Synthetic construct
gttctagttctctctctccc

SEQ ID NO: 1182 - DNA, 20 bp, Artificial Sequence
  Synthetic construct
tcgaacctccacttcctccc

SEQ ID NO: 1183 - DNA, 21 bp, Artificial Sequence
  Synthetic construct
cttcttctttcttctcgtccc

SEQ ID NO: 1184 - DNA, 20 bp, Artificial Sequence
  Synthetic construct
tcttctttcttctcgtccct

SEQ ID NO: 1185 - DNA, 21 bp, Artificial Sequence
  Synthetic construct
tcttctttcttctcgtccctt

SEQ ID NO: 1186 - DNA, 21 bp, Artificial Sequence
  Synthetic construct
ttcttctttcttctcgtccct

SEQ ID NO: 1187 - DNA, 20 bp, Artificial Sequence
  Synthetic construct
tctagttctctctctccctt

SEQ ID NO: 1188 - DNA, 20 bp, Artificial Sequence
  Synthetic construct
ttctagttctctctctccct

SEQ ID NO: 1189 - DNA, 20 bp, Artificial Sequence
  Synthetic construct
cttctttcttctcgtccctt

SEQ ID NO: 1190 - DNA, 21 bp, Artificial Sequence
  Synthetic construct
tctcctctgtcccttcccact

SEQ ID NO: 1191 - DNA, 20 bp, Artificial Sequence
  Synthetic construct
ctcctctgtcccttcccact

SEQ ID NO: 1192 - DNA, 20 bp, Artificial Sequence
  Synthetic construct
tctcctctgtcccttcccac

SEQ ID NO: 1193 - DNA, 21 bp, Artificial Sequence
  Synthetic construct
atctcctctgtcccttcccac

SEQ ID NO: 1194 - DNA, 19 bp, Artificial Sequence
  Synthetic construct
atctcctctgtcccttccc

SEQ ID NO: 1195 - DNA, 19 bp, Artificial Sequence
  Synthetic construct
tcctctgtcccttcccact

SEQ ID NO: 1196 - DNA, 20 bp, Artificial Sequence
  Synthetic construct
tcctctgtcccttcccactg

SEQ ID NO: 1197 - DNA, 20 bp, Artificial Sequence
  Synthetic construct
gatctcctctgtcccttccc

SEQ ID NO: 1198 - DNA, 19 bp, Artificial Sequence
  Synthetic construct
tctcctctgtcccttccca

SEQ ID NO: 1199 - DNA, 21 bp, Artificial Sequence
  Synthetic construct
gatctcctctgtcccttccca

SEQ ID NO: 1200 - DNA, 20 bp, Artificial Sequence
  Synthetic construct
ctcctgctcatccttcctct

SEQ ID NO: 1201 - DNA, 21 bp, Artificial Sequence
  Synthetic construct
ctcctgctcatccttcctctg

SEQ ID NO: 1202 - DNA, 20 bp, Artificial Sequence
  Synthetic construct
gtcccgctgtctcatttgtg

SEQ ID NO: 1203 - DNA, 20 bp, Artificial Sequence
  Synthetic construct
tcccgctcctgctcatcctt

SEQ ID NO: 1204 - DNA, 20 bp, Artificial Sequence
  Synthetic construct
tcctgctcatccttcctctg

SEQ ID NO: 1205 - DNA, 20 bp, Artificial Sequence
  Synthetic construct
cgtcccgctgtctcatttgt

SEQ ID NO: 1206 - DNA, 19 bp, Artificial Sequence
  Synthetic construct
gtcccgctgtctcatttgt

SEQ ID NO: 1207 - DNA, 19 bp, Artificial Sequence
  Synthetic construct
tcctgctcatccttcctct

SEQ ID NO: 1208 - DNA, 21 bp, Artificial Sequence
  Synthetic construct
cgtcccgctgtctcatttgtg

SEQ ID NO: 1209 - DNA, 21 bp, Artificial Sequence
  Synthetic construct
gctcaccactttctcgtccac

SEQ ID NO: 1210 - DNA, 20 bp, Artificial Sequence
  Synthetic construct
gttacatactcgccacctct

SEQ ID NO: 1211 - DNA, 21 bp, Artificial Sequence
  Synthetic construct
gttacatactcgccacctctg

SEQ ID NO: 1212 - DNA, 20 bp, Artificial Sequence
  Synthetic construct
tccacctctctgccaagttt

SEQ ID NO: 1213 - DNA, 20 bp, Artificial Sequence
  Synthetic construct
ttccacctctctgccaagtt

SEQ ID NO: 1214 - DNA, 20 bp, Artificial Sequence
  Synthetic construct
tttccacctctctgccaagt

SEQ ID NO: 1215 - DNA, 21 bp, Artificial Sequence
  Synthetic construct
tccacctctctgccaagtttg

SEQ ID NO: 1216 - DNA, 21 bp, Artificial Sequence
  Synthetic construct
ttccacctctctgccaagttt

SEQ ID NO: 1217 - DNA, 21 bp, Artificial Sequence
  Synthetic construct
tttccacctctctgccaagtt

SEQ ID NO: 1218 - DNA, 19 bp, Artificial Sequence
  Synthetic construct
tccacctctctgccaagtt

SEQ ID NO: 1219 - DNA, 19 bp, Artificial Sequence
  Synthetic construct
ttccacctctctgccaagt

SEQ ID NO: 1220 - DNA, 20 bp, Artificial Sequence
  Synthetic construct
gtccttaccaccatcgccct

SEQ ID NO: 1221 - DNA, 19 bp, Artificial Sequence
  Synthetic construct
gctgtactcctccctgtga

SEQ ID NO: 1222 - DNA, 19 bp, Artificial Sequence
  Synthetic construct
tccttaccaccatcgccct

SEQ ID NO: 1223 - DNA, 20 bp, Artificial Sequence
  Synthetic construct
gctgtactcctccctgtgaa

SEQ ID NO: 1224 - DNA, 21 bp, Artificial Sequence
  Synthetic construct
tccttaccaccatcgccctgt

SEQ ID NO: 1225 - DNA, 20 bp, Artificial Sequence
  Synthetic construct
ccttaccaccatcgccctgt

SEQ ID NO: 1226 - DNA, 20 bp, Artificial Sequence
  Synthetic construct
agctgtactcctccctgtga

SEQ ID NO: 1227 - DNA, 21 bp, Artificial Sequence
  Synthetic construct
gctgtactcctccctgtgaat

SEQ ID NO: 1228 - DNA, 21 bp, Artificial Sequence
  Synthetic construct
ccttaccaccatcgccctgtt

SEQ ID NO: 1229 - DNA, 20 bp, Artificial Sequence
  Synthetic construct
accaccatcgccctgtttct

SEQ ID NO: 1230 - DNA, 20 bp, Artificial Sequence
  Synthetic construct
tcctgaccacccacttccca

SEQ ID NO: 1231 - DNA, 20 bp, Artificial Sequence
  Synthetic construct
ccttctctcctgaccaccca

SEQ ID NO: 1232 - DNA, 21 bp, Artificial Sequence
  Synthetic construct
tcctgaccacccacttcccaa

SEQ ID NO: 1233 - DNA, 20 bp, Artificial Sequence
  Synthetic construct
gtctccacctccacatcgct

SEQ ID NO: 1234 - DNA, 20 bp, Artificial Sequence
  Synthetic construct
cctgaccacccacttcccaa

SEQ ID NO: 1235 - DNA, 20 bp, Artificial Sequence
  Synthetic construct
cccacttcccaatctttcct

SEQ ID NO: 1236 - DNA, 21 bp, Artificial Sequence
  Synthetic construct
acccacttcccaatctttcct

SEQ ID NO: 1237 - DNA, 21 bp, Artificial Sequence
  Synthetic construct
cccacttcccaatctttcctg

SEQ ID NO: 1238 - DNA, 19 bp, Artificial Sequence
  Synthetic construct
accacccacttcccaatct

SEQ ID NO: 1239 - DNA, 21 bp, Artificial Sequence
  Synthetic construct
cacccacttcccaatctttcc

SEQ ID NO: 1240 - RNA, 19 nt, Artificial Sequence
  Synthetic construct
gccuggagaucuacaagaa

SEQ ID NO: 1241 - RNA, 19 nt, Artificial Sequence
  Synthetic construct
uccuugaugucaugcucaa

SEQ ID NO: 1242 - RNA, 19 nt, Artificial Sequence
  Synthetic construct
ggacgagaagcugaaggau

SEQ ID NO: 1243 - RNA, 19 nt, Artificial Sequence
  Synthetic construct
cccgaggauugugcacuau

SEQ ID NO: 1244 - RNA, 19 nt, Artificial Sequence
  Synthetic construct
ccgaggauugugcacuauu

SEQ ID NO: 1245 - RNA, 19 nt, Artificial Sequence
  Synthetic construct
gcgucuacggaugagcauu

SEQ ID NO: 1246 - RNA, 19 nt, Artificial Sequence
  Synthetic construct
gcaugagaaguuuaccauu

SEQ ID NO: 1247 - RNA, 19 nt, Artificial Sequence
  Synthetic construct
ccauggauauuucugcuau

SEQ ID NO: 1248 - RNA, 19 nt, Artificial Sequence
  Synthetic construct
gcaugcuucauuuaccauu

SEQ ID NO: 1249 - RNA, 19 nt, Artificial Sequence
  Synthetic construct
ccucuacuccuucuucuuu

SEQ ID NO: 1250 - RNA, 19 nt, Artificial Sequence
  Synthetic construct
ggaaggcgaugacucagau

SEQ ID NO: 1251 - RNA, 19 nt, Artificial Sequence
  Synthetic construct
ggaagauuccagaagugaa

SEQ ID NO: 1252 - RNA, 19 nt, Artificial Sequence
  Synthetic construct
ccuccuucagacacgacaa

SEQ ID NO: 1253 - RNA, 19 nt, Artificial Sequence
  Synthetic construct
ccuucagacacgacaagcu

SEQ ID NO: 1254 - RNA, 19 nt, Artificial Sequence
  Synthetic construct
ggcaguuuccguuugacuu

SEQ ID NO: 1255 - RNA, 19 nt, Artificial Sequence
  Synthetic construct
ggagguuccuagaguuguu

SEQ ID NO: 1256 - RNA, 19 nt, Artificial Sequence
  Synthetic construct
gcacaauccaaagagacaa

SEQ ID NO: 1257 - RNA, 19 nt, Artificial Sequence
  Synthetic construct
gcggagaucgaugccauaa

SEQ ID NO: 1258 - RNA, 19 nt, Artificial Sequence
  Synthetic construct
gcagcaacaucuacccuuu

SEQ ID NO: 1259 - RNA, 19 nt, Artificial Sequence
  Synthetic construct
ccaaacaucugguuggcaa

SEQ ID NO: 1260 - RNA, 19 nt, Artificial Sequence
  Synthetic construct
ugaccugcaagacucacaa

SEQ ID NO: 1261 - RNA, 19 nt, Artificial Sequence
  Synthetic construct
gaccugcaagacucacaag

SEQ ID NO: 1262 - RNA, 19 nt, Artificial Sequence
  Synthetic construct
ccugcaagacucacaagag

SEQ ID NO: 1263 - RNA, 19 nt, Artificial Sequence
  Synthetic construct
ugcugacaagaaagccgau

SEQ ID NO: 1264 - RNA, 19 nt, Artificial Sequence
  Synthetic construct
gcugacaagaaagccgaug

SEQ ID NO: 1265 - RNA, 19 nt, Artificial Sequence
  Synthetic construct
gggaugugcuggaugugau

SEQ ID NO: 1266 - RNA, 19 nt, Artificial Sequence
  Synthetic construct
ggaugugauaggccagguu

SEQ ID NO: 1267 - RNA, 19 nt, Artificial Sequence
  Synthetic construct
gcaaguaaauggacaguua

SEQ ID NO: 1268 - RNA, 19 nt, Artificial Sequence
  Synthetic construct
ggaacauacauggccugaa

SEQ ID NO: 1269 - RNA, 19 nt, Artificial Sequence
  Synthetic construct
gcccuccaauaugcuagua

SEQ ID NO: 1270 - RNA, 19 nt, Artificial Sequence
  Synthetic construct
gcaucacacagcagaucua

SEQ ID NO: 1271 - RNA, 19 nt, Artificial Sequence
  Synthetic construct
gcagauuucugugccucau

SEQ ID NO: 1272 - RNA, 19 nt, Artificial Sequence
  Synthetic construct
gcuuguagauaaccucuaa

SEQ ID NO: 1273 - RNA, 19 nt, Artificial Sequence
  Synthetic construct
gcuccaagccuggaaucuu

SEQ ID NO: 1274 - RNA, 19 nt, Artificial Sequence
  Synthetic construct
gccaccaucucaaucagua

SEQ ID NO: 1275 - RNA, 19 nt, Artificial Sequence
  Synthetic construct
gcaagcugccgauaaguau

SEQ ID NO: 1276 - RNA, 19 nt, Artificial Sequence
  Synthetic construct
gcaaauucauucgcaucaa

SEQ ID NO: 1277 - RNA, 19 nt, Artificial Sequence
  Synthetic construct
ggagccaacauugagacuu

SEQ ID NO: 1278 - RNA, 19 nt, Artificial Sequence
  Synthetic construct
ccaugaggauuaugggcau

SEQ ID NO: 1279 - RNA, 19 nt, Artificial Sequence
  Synthetic construct
ccagaaggcgcagacuaaa

SEQ ID NO: 1280 - RNA, 19 nt, Artificial Sequence
  Synthetic construct
ggaguuacuagagucacua

SEQ ID NO: 1281 - RNA, 19 nt, Artificial Sequence
  Synthetic construct
gaguuacuagagucacuau

SEQ ID NO: 1282 - RNA, 19 nt, Artificial Sequence
  Synthetic construct
gucacuauccggaaaucua

SEQ ID NO: 1283 - RNA, 19 nt, Artificial Sequence
  Synthetic construct
ucacuauccggaaaucuaa

SEQ ID NO: 1284 - RNA, 19 nt, Artificial Sequence
  Synthetic construct
gaagccaagaucgaagauu

SEQ ID NO: 1285 - RNA, 19 nt, Artificial Sequence
  Synthetic construct
gccaggaauguucgguuau

SEQ ID NO: 1286 - RNA, 19 nt, Artificial Sequence
  Synthetic construct
ggagagugcccuuugcauu

SEQ ID NO: 1287 - RNA, 19 nt, Artificial Sequence
  Synthetic construct
ccuuaggagaagguggcuu

SEQ ID NO: 1288 - RNA, 19 nt, Artificial Sequence
  Synthetic construct
cccaguagcccuauuccaa

SEQ ID NO: 1289 - RNA, 19 nt, Artificial Sequence
  Synthetic construct
gggaccgucuuucgauaua

SEQ ID NO: 1290 - RNA, 19 nt, Artificial Sequence
  Synthetic construct
gggcuaaagugaccaugaa

SEQ ID NO: 1291 - RNA, 19 nt, Artificial Sequence
  Synthetic construct
ggcuaaagugaccaugaau

SEQ ID NO: 1292 - RNA, 19 nt, Artificial Sequence
  Synthetic construct
ccuuggcaagggaaccuuu

SEQ ID NO: 1293 - RNA, 19 nt, Artificial Sequence
  Synthetic construct
gcaagggaaccuuuggcaa

SEQ ID NO: 1294 - RNA, 19 nt, Artificial Sequence
  Synthetic construct
gcggaaggaagucaucauu

SEQ ID NO: 1295 - RNA, 19 nt, Artificial Sequence
  Synthetic construct
gcaucaggucaacucucua

SEQ ID NO: 1296 - RNA, 19 nt, Artificial Sequence
  Synthetic construct
ccucaauucuguugaucuu

SEQ ID NO: 1297 - RNA, 19 nt, Artificial Sequence
  Synthetic construct
ccaagaguacagugaauuu

SEQ ID NO: 1298 - RNA, 19 nt, Artificial Sequence
  Synthetic construct
gcucuaacagugcagauau

SEQ ID NO: 1299 - RNA, 19 nt, Artificial Sequence
  Synthetic construct
gcagauauaacagguccuu

SEQ ID NO: 1300 - RNA, 19 nt, Artificial Sequence
  Synthetic construct
gaggcaagcucagcaagaa

SEQ ID NO: 1301 - RNA, 19 nt, Artificial Sequence
  Synthetic construct
gaagaagaagggcuacaau

SEQ ID NO: 1302 - RNA, 19 nt, Artificial Sequence
  Synthetic construct
gaagggcuacaaugugaac

SEQ ID NO: 1303 - RNA, 19 nt, Artificial Sequence
  Synthetic construct
gggcuacaaugugaacgac

SEQ ID NO: 1304 - RNA, 19 nt, Artificial Sequence
  Synthetic construct
ggcuacaaugugaacgacg

SEQ ID NO: 1305 - RNA, 19 nt, Artificial Sequence
  Synthetic construct
gccuguaagagugagacua

SEQ ID NO: 1306 - RNA, 19 nt, Artificial Sequence
  Synthetic construct
ccuguaagagugagacuaa

SEQ ID NO: 1307 - RNA, 19 nt, Artificial Sequence
  Synthetic construct
gggccaacaaugaguuguu

SEQ ID NO: 1308 - RNA, 19 nt, Artificial Sequence
  Synthetic construct
cccugcuuaugccaagcaa

SEQ ID NO: 1309 - RNA, 19 nt, Artificial Sequence
  Synthetic construct
gggaucuuguacucucuaa

SEQ ID NO: 1310 - RNA, 19 nt, Artificial Sequence
  Synthetic construct
ggaugaaauagacucagaa

SEQ ID NO: 1311 - RNA, 19 nt, Artificial Sequence
  Synthetic construct
gcauguaugaugacagaaa

SEQ ID NO: 1312 - RNA, 19 nt, Artificial Sequence
  Synthetic construct
ccggauaaagcauggcaau

SEQ ID NO: 1313 - RNA, 19 nt, Artificial Sequence
  Synthetic construct
gcaaugacugggcaacaau

SEQ ID NO: 1314 - RNA, 19 nt, Artificial Sequence
  Synthetic construct
gcgcuaggaagaagugcau

SEQ ID NO: 1315 - RNA, 19 nt, Artificial Sequence
  Synthetic construct
ccacccgaauuggcagauu

SEQ ID NO: 1316 - RNA, 19 nt, Artificial Sequence
  Synthetic construct
gcaaagaucucaugggcuu

SEQ ID NO: 1317 - RNA, 19 nt, Artificial Sequence
  Synthetic construct
ccaagauaccaugaaccau

SEQ ID NO: 1318 - RNA, 19 nt, Artificial Sequence
  Synthetic construct
gcauccagcaggauaucaa

SEQ ID NO: 1319 - RNA, 19 nt, Artificial Sequence
  Synthetic construct
gcugucagccugucagaau

SEQ ID NO: 1320 - RNA, 19 nt, Artificial Sequence
  Synthetic construct
gcaacuccaauuaaacuca

SEQ ID NO: 1321 - RNA, 19 nt, Artificial Sequence
  Synthetic construct
ggaagcugugugcccauua

SEQ ID NO: 1322 - RNA, 19 nt, Artificial Sequence
  Synthetic construct
gcccauuaccagcaaucag

SEQ ID NO: 1323 - RNA, 19 nt, Artificial Sequence
  Synthetic construct
gcccuucaauacuuucaag

SEQ ID NO: 1324 - RNA, 19 nt, Artificial Sequence
  Synthetic construct
gguugcggcaagaacacua

SEQ ID NO: 1325 - RNA, 19 nt, Artificial Sequence
  Synthetic construct
gcggguacaauuaaagaua

SEQ ID NO: 1326 - RNA, 19 nt, Artificial Sequence
  Synthetic construct
gcauguaacacuccacuuu

SEQ ID NO: 1327 - RNA, 19 nt, Artificial Sequence
  Synthetic construct
ccuucaguauuuguaacuu

SEQ ID NO: 1328 - RNA, 19 nt, Artificial Sequence
  Synthetic construct
ccuggacucuaccuaguaa

SEQ ID NO: 1329 - RNA, 19 nt, Artificial Sequence
  Synthetic construct
gcacgugacuggacaauuu

SEQ ID NO: 1330 - RNA, 19 nt, Artificial Sequence
  Synthetic construct
cggcagcaugaugaagaag

SEQ ID NO: 1331 - RNA, 19 nt, Artificial Sequence
  Synthetic construct
gccucaucauccaguccaa

SEQ ID NO: 1332 - RNA, 19 nt, Artificial Sequence
  Synthetic construct
ccucaucauccaguccaac

SEQ ID NO: 1333 - RNA, 19 nt, Artificial Sequence
  Synthetic construct
cgagcucacaguuccucua

SEQ ID NO: 1334 - RNA, 19 nt, Artificial Sequence
  Synthetic construct
gagcucacaguuccucuac

SEQ ID NO: 1335 - RNA, 19 nt, Artificial Sequence
  Synthetic construct
gcuaaagaagguggaccua

SEQ ID NO: 1336 - RNA, 19 nt, Artificial Sequence
  Synthetic construct
gcgaugaaucagcagccaa

SEQ ID NO: 1337 - RNA, 19 nt, Artificial Sequence
  Synthetic construct
gcagccaagaagcccaaau

SEQ ID NO: 1338 - RNA, 19 nt, Artificial Sequence
  Synthetic construct
gcauuugcacacgauucaa

SEQ ID NO: 1339 - RNA, 19 nt, Artificial Sequence
  Synthetic construct
gcauaguaaaugacaaaua

SEQ ID NO: 1340 - RNA, 19 nt, Artificial Sequence
  Synthetic construct
gccaggccuucaagaacau

SEQ ID NO: 1341 - RNA, 19 nt, Artificial Sequence
  Synthetic construct
ccagcaagucguugguaaa

SEQ ID NO: 1342 - RNA, 19 nt, Artificial Sequence
  Synthetic construct
ccaguucccaaaguaacaa

SEQ ID NO: 1343 - RNA, 19 nt, Artificial Sequence
  Synthetic construct
ccaaaguaacaauaaucaa

SEQ ID NO: 1344 - RNA, 19 nt, Artificial Sequence
  Synthetic construct
gccacaauguccaagacuu

SEQ ID NO: 1345 - RNA, 19 nt, Artificial Sequence
  Synthetic construct
gcaacuacacaaauucaau

SEQ ID NO: 1346 - RNA, 19 nt, Artificial Sequence
  Synthetic construct
ggaggaguccugacucaua

SEQ ID NO: 1347 - RNA, 19 nt, Artificial Sequence
  Synthetic construct
ggaguccugacucauacuu

SEQ ID NO: 1348 - RNA, 19 nt, Artificial Sequence
  Synthetic construct
gaguccugacucauacuuu

SEQ ID NO: 1349 - RNA, 19 nt, Artificial Sequence
  Synthetic construct
ccugacucauacuuucucu

SEQ ID NO: 1350 - RNA, 19 nt, Artificial Sequence
  Synthetic construct
gcaccaaggcgcaguauau

SEQ ID NO: 1351 - RNA, 19 nt, Artificial Sequence
  Synthetic construct
gcaguucugccuugagcua

SEQ ID NO: 1352 - RNA, 19 nt, Artificial Sequence
  Synthetic construct
ccuugagcuaaauggacuu

SEQ ID NO: 1353 - RNA, 19 nt, Artificial Sequence
  Synthetic construct
ccagauacuugcacucaaa

SEQ ID NO: 1354 - RNA, 19 nt, Artificial Sequence
  Synthetic construct
gcugcaugucuucugaaua

SEQ ID NO: 1355 - RNA, 19 nt, Artificial Sequence
  Synthetic construct
gcuacgauuucacacuauu

SEQ ID NO: 1356 - RNA, 19 nt, Artificial Sequence
  Synthetic construct
gcugcuuuaucucaguaua

SEQ ID NO: 1357 - RNA, 19 nt, Artificial Sequence
  Synthetic construct
ccauggaaaucucaguuau

SEQ ID NO: 1358 - RNA, 19 nt, Artificial Sequence
  Synthetic construct
gcagauccagcuuuauuaa

SEQ ID NO: 1359 - RNA, 19 nt, Artificial Sequence
  Synthetic construct
gcacauuggugccuuucuu

SEQ ID NO: 1360 - RNA, 19 nt, Artificial Sequence
  Synthetic construct
gcaugagauuucugaaauu

SEQ ID NO: 1361 - RNA, 19 nt, Artificial Sequence
  Synthetic construct
gcaggagaauaaugagaaa

SEQ ID NO: 1362 - RNA, 19 nt, Artificial Sequence
  Synthetic construct
gcucaugaaaucaguuuaa

SEQ ID NO: 1363 - RNA, 19 nt, Artificial Sequence
  Synthetic construct
ggaaggaaauauaaagcaa

SEQ ID NO: 1364 - RNA, 19 nt, Artificial Sequence
  Synthetic construct
gcugauaugccgagcauua

SEQ ID NO: 1365 - RNA, 19 nt, Artificial Sequence
  Synthetic construct
ucgccuacaccugguucaa

SEQ ID NO: 1366 - RNA, 19 nt, Artificial Sequence
  Synthetic construct
ccuacaccugguucaaccu

SEQ ID NO: 1367 - RNA, 19 nt, Artificial Sequence
  Synthetic construct
ucauggucauccuguucaa

SEQ ID NO: 1368 - RNA, 19 nt, Artificial Sequence
  Synthetic construct
ucauccuguucaagggcau

SEQ ID NO: 1369 - RNA, 19 nt, Artificial Sequence
  Synthetic construct
gagcgagaugcagagcaaa

SEQ ID NO: 1370 - RNA, 19 nt, Artificial Sequence
  Synthetic construct
cucacugaguauuagccuu

SEQ ID NO: 1371 - RNA, 19 nt, Artificial Sequence
  Synthetic construct
gucucucgcuguggguauu

SEQ ID NO: 1372 - RNA, 19 nt, Artificial Sequence
  Synthetic construct
gcuguggguauucaccgaa

SEQ ID NO: 1373 - RNA, 19 nt, Artificial Sequence
  Synthetic construct
cuguggguauucaccgaau

SEQ ID NO: 1374 - RNA, 19 nt, Artificial Sequence
  Synthetic construct
ggguauucaccgaaucucu

SEQ ID NO: 1375 - RNA, 19 nt, Artificial Sequence
  Synthetic construct
ggaucggcaacuaaaccau

SEQ ID NO: 1376 - RNA, 19 nt, Artificial Sequence
  Synthetic construct
gcuguucaaucuacaauaa

SEQ ID NO: 1377 - RNA, 19 nt, Artificial Sequence
  Synthetic construct
ggcuuuacagagcaagaau

SEQ ID NO: 1378 - RNA, 19 nt, Artificial Sequence
  Synthetic construct
gcuuuacagagcaagaauu

SEQ ID NO: 1379 - RNA, 19 nt, Artificial Sequence
  Synthetic construct
cccaaagucagaccaacuu

SEQ ID NO: 1380 - RNA, 19 nt, Artificial Sequence
  Synthetic construct
ucuccaguguaaugauuau

SEQ ID NO: 1381 - RNA, 19 nt, Artificial Sequence
  Synthetic construct
gcaucaaucugguggugac

SEQ ID NO: 1382 - RNA, 19 nt, Artificial Sequence
  Synthetic construct
gcaaucacauugcucugua

SEQ ID NO: 1383 - RNA, 19 nt, Artificial Sequence
  Synthetic construct
gcacucagaagggaaguua

SEQ ID NO: 1384 - RNA, 19 nt, Artificial Sequence
  Synthetic construct
gcgcaaguacaucucccuu

SEQ ID NO: 1385 - RNA, 19 nt, Artificial Sequence
  Synthetic construct
gcuucaaacgagucagaau

SEQ ID NO: 1386 - RNA, 19 nt, Artificial Sequence
  Synthetic construct
gcuccagcugcauaagacu

SEQ ID NO: 1387 - RNA, 19 nt, Artificial Sequence
  Synthetic construct
ccagcugcauaagacugag

SEQ ID NO: 1388 - RNA, 19 nt, Artificial Sequence
  Synthetic construct
gcugcauaagacugaguuu

SEQ ID NO: 1389 - RNA, 19 nt, Artificial Sequence
  Synthetic construct
gcauaagacugaguuucug

SEQ ID NO: 1390 - RNA, 19 nt, Artificial Sequence
  Synthetic construct
gccaguaaagcugaaugaa

SEQ ID NO: 1391 - RNA, 19 nt, Artificial Sequence
  Synthetic construct
ccaguaaagcugaaugaaa

SEQ ID NO: 1392 - RNA, 19 nt, Artificial Sequence
  Synthetic construct
gggaaggaaaugugcccaa

SEQ ID NO: 1393 - RNA, 19 nt, Artificial Sequence
  Synthetic construct
ccacaagcauucugugcuu

SEQ ID NO: 1394 - RNA, 19 nt, Artificial Sequence
  Synthetic construct
gcuucgcccuugcuuguaa

SEQ ID NO: 1395 - RNA, 19 nt, Artificial Sequence
  Synthetic construct
cccagaaugccgagaugau

SEQ ID NO: 1396 - RNA, 19 nt, Artificial Sequence
  Synthetic construct
ccuugugcuggguccaauu

SEQ ID NO: 1397 - RNA, 19 nt, Artificial Sequence
  Synthetic construct
gguucgggacauagagaau

SEQ ID NO: 1398 - RNA, 19 nt, Artificial Sequence
  Synthetic construct
gggacauagagaaucugaa

SEQ ID NO: 1399 - RNA, 19 nt, Artificial Sequence
  Synthetic construct
gccuacucgaauccaacaa

SEQ ID NO: 1400 - RNA, 19 nt, Artificial Sequence
  Synthetic construct
ggaaugggacaagacccau

SEQ ID NO: 1401 - RNA, 19 nt, Artificial Sequence
  Synthetic construct
ggacaagacccaucuuuau

SEQ ID NO: 1402 - RNA, 19 nt, Artificial Sequence
  Synthetic construct
ccagcaucucauaaucuau

SEQ ID NO: 1403 - RNA, 19 nt, Artificial Sequence
  Synthetic construct
ccagggugaauacagguau

SEQ ID NO: 1404 - RNA, 19 nt, Artificial Sequence
  Synthetic construct
gccucuaucuuacagagca

SEQ ID NO: 1405 - RNA, 19 nt, Artificial Sequence
  Synthetic construct
ugagcuccgugaggauaaa

SEQ ID NO: 1406 - RNA, 19 nt, Artificial Sequence
  Synthetic construct
gagcuccgugaggauaaau

SEQ ID NO: 1407 - RNA, 19 nt, Artificial Sequence
  Synthetic construct
agcuccgugaggauaaaua

SEQ ID NO: 1408 - RNA, 19 nt, Artificial Sequence
  Synthetic construct
gcuccgugaggauaaauaa

SEQ ID NO: 1409 - RNA, 19 nt, Artificial Sequence
  Synthetic construct
uccgugaggauaaauaacu

SEQ ID NO: 1410 - RNA, 19 nt, Artificial Sequence
  Synthetic construct
acgaacugaacucucucuu

SEQ ID NO: 1411 - RNA, 19 nt, Artificial Sequence
  Synthetic construct
cgaacugaacucucucuuu

SEQ ID NO: 1412 - RNA, 19 nt, Artificial Sequence
  Synthetic construct
acugaacucucucuuucug

SEQ ID NO: 1413 - RNA, 19 nt, Artificial Sequence
  Synthetic construct
ucaagugaugucaucuuac

SEQ ID NO: 1414 - RNA, 19 nt, Artificial Sequence
  Synthetic construct
cagaugauuugaauugaua

SEQ ID NO: 1415 - RNA, 19 nt, Artificial Sequence
  Synthetic construct
agaugauuugaauugauaa

SEQ ID NO: 1416 - RNA, 19 nt, Artificial Sequence
  Synthetic construct
gaugauuugaauugauaag

SEQ ID NO: 1417 - RNA, 19 nt, Artificial Sequence
  Synthetic construct
gaauugauaagcugauguu

SEQ ID NO: 1418 - RNA, 19 nt, Artificial Sequence
  Synthetic construct
agcauguuagaguucugau

SEQ ID NO: 1419 - RNA, 19 nt, Artificial Sequence
  Synthetic construct
gcucacuaugaccgacagu

SEQ ID NO: 1420 - RNA, 19 nt, Artificial Sequence
  Synthetic construct
ggaaucucguucggcugau

SEQ ID NO: 1421 - RNA, 19 nt, Artificial Sequence
  Synthetic construct
gaaucucguucggcugaug

SEQ ID NO: 1422 - RNA, 19 nt, Artificial Sequence
  Synthetic construct
cucguucggcugaugacuu

SEQ ID NO: 1423 - RNA, 19 nt, Artificial Sequence
  Synthetic construct
ucguucggcugaugacuug

SEQ ID NO: 1424 - RNA, 19 nt, Artificial Sequence
  Synthetic construct
ccagugaugaguugaauac

SEQ ID NO: 1425 - RNA, 19 nt, Artificial Sequence
  Synthetic construct
gucugaucaaugugugacu

SEQ ID NO: 1426 - RNA, 19 nt, Artificial Sequence
  Synthetic construct
ucugaucaaugugugacug

SEQ ID NO: 1427 - RNA, 19 nt, Artificial Sequence
  Synthetic construct
ugaucaaugugugacugaa

SEQ ID NO: 1428 - RNA, 19 nt, Artificial Sequence
  Synthetic construct
gaucaaugugugacugaaa

SEQ ID NO: 1429 - RNA, 19 nt, Artificial Sequence
  Synthetic construct
ggacaaguguuauaccguu

SEQ ID NO: 1430 - RNA, 19 nt, Artificial Sequence
  Synthetic construct
gcaguuguugcagcucaaa

SEQ ID NO: 1431 - RNA, 19 nt, Artificial Sequence
  Synthetic construct
gcaacuuuacaaucaaaua

SEQ ID NO: 1432 - RNA, 19 nt, Artificial Sequence
  Synthetic construct
gcggaaggaguagaguuua

SEQ ID NO: 1433 - RNA, 19 nt, Artificial Sequence
  Synthetic construct
gcuuuccaagaaacaacua

SEQ ID NO: 1434 - RNA, 19 nt, Artificial Sequence
  Synthetic construct
gcuauagaaggcccuauua

SEQ ID NO: 1435 - RNA, 19 nt, Artificial Sequence
  Synthetic construct
ccgcucaaauuggcagaau

SEQ ID NO: 1436 - RNA, 19 nt, Artificial Sequence
  Synthetic construct
gcucaaauuggcagaauua

SEQ ID NO: 1437 - RNA, 19 nt, Artificial Sequence
  Synthetic construct
ccaggagccauucuagaaa

SEQ ID NO: 1438 - RNA, 19 nt, Artificial Sequence
  Synthetic construct
ccgagugacugcuuauaaa

SEQ ID NO: 1439 - RNA, 19 nt, Artificial Sequence
  Synthetic construct
gggagagacugucaaagcu

SEQ ID NO: 1440 - RNA, 19 nt, Artificial Sequence
  Synthetic construct
gccgguaauuuggucaaca

SEQ ID NO: 1441 - RNA, 19 nt, Artificial Sequence
  Synthetic construct
gguaauuuggucaacacuu

SEQ ID NO: 1442 - RNA, 19 nt, Artificial Sequence
  Synthetic construct
ggacacuuguggaccgaau

SEQ ID NO: 1443 - RNA, 19 nt, Artificial Sequence
  Synthetic construct
gcuugccucuacuaccugu

SEQ ID NO: 1444 - RNA, 19 nt, Artificial Sequence
  Synthetic construct
ggagggucgucucaaguau

SEQ ID NO: 1445 - RNA, 19 nt, Artificial Sequence
  Synthetic construct
gcuaagagauaucugcaau

SEQ ID NO: 1446 - RNA, 19 nt, Artificial Sequence
  Synthetic construct
ggagauuacuaccguuacu

SEQ ID NO: 1447 - RNA, 19 nt, Artificial Sequence
  Synthetic construct
ggaaaugcaaccaacacau

SEQ ID NO: 1448 - RNA, 19 nt, Artificial Sequence
  Synthetic construct
gcccuuaacuucucugugu

SEQ ID NO: 1449 - RNA, 19 nt, Artificial Sequence
  Synthetic construct
ggucaucauuccugagcaa

SEQ ID NO: 1450 - RNA, 19 nt, Artificial Sequence
  Synthetic construct
ccagcaggaugaugacaaa

SEQ ID NO: 1451 - RNA, 19 nt, Artificial Sequence
  Synthetic construct
ccagaagaugaagauuuaa

SEQ ID NO: 1452 - RNA, 19 nt, Artificial Sequence
  Synthetic construct
gcagcaaauggaugacaau

SEQ ID NO: 1453 - RNA, 19 nt, Artificial Sequence
  Synthetic construct
gcagcagcuuaugguaaua

SEQ ID NO: 1454 - RNA, 19 nt, Artificial Sequence
  Synthetic construct
ggucauccagcuuguccuu

SEQ ID NO: 1455 - RNA, 19 nt, Artificial Sequence
  Synthetic construct
gcuuguccuuuagucagua

SEQ ID NO: 1456 - RNA, 19 nt, Artificial Sequence
  Synthetic construct
ccuuuagucaguagaucua

SEQ ID NO: 1457 - RNA, 19 nt, Artificial Sequence
  Synthetic construct
ccagucuuucaagaaguaa

SEQ ID NO: 1458 - RNA, 19 nt, Artificial Sequence
  Synthetic construct
gcaucuacaaagaaggcua

SEQ ID NO: 1459 - RNA, 19 nt, Artificial Sequence
  Synthetic construct
gccaccaucagguuuguca

SEQ ID NO: 1460 - RNA, 19 nt, Artificial Sequence
  Synthetic construct
ccaccaucagguuugucau

SEQ ID NO: 1461 - RNA, 19 nt, Artificial Sequence
  Synthetic construct
ccaucagguuugucaugaa

SEQ ID NO: 1462 - RNA, 19 nt, Artificial Sequence
  Synthetic construct
gguuugucaugaagugcua

SEQ ID NO: 1463 - RNA, 19 nt, Artificial Sequence
  Synthetic construct
gcuccacuucccuuggaau

SEQ ID NO: 1464 - RNA, 19 nt, Artificial Sequence
  Synthetic construct
gcaauuggaagcagcaaau

SEQ ID NO: 1465 - RNA, 19 nt, Artificial Sequence
  Synthetic construct
ccuugggagucagacauuu

SEQ ID NO: 1466 - RNA, 19 nt, Artificial Sequence
  Synthetic construct
gcagcacccaagacucaaa

SEQ ID NO: 1467 - RNA, 19 nt, Artificial Sequence
  Synthetic construct
gcacccaagacucaaacaa

SEQ ID NO: 1468 - RNA, 19 nt, Artificial Sequence
  Synthetic construct
gccauuggcaaagcagcaa

SEQ ID NO: 1469 - RNA, 19 nt, Artificial Sequence
  Synthetic construct
gcaaggguucugggauaaa

SEQ ID NO: 1470 - RNA, 19 nt, Artificial Sequence
  Synthetic construct
gcacagaagccuucuuuaa

SEQ ID NO: 1471 - RNA, 19 nt, Artificial Sequence
  Synthetic construct
ccauggauucuguggcuuu

SEQ ID NO: 1472 - RNA, 19 nt, Artificial Sequence
  Synthetic construct
gccauaugauuuaucggaa

SEQ ID NO: 1473 - RNA, 19 nt, Artificial Sequence
  Synthetic construct
gggaugaauuuggcuucau

SEQ ID NO: 1474 - RNA, 19 nt, Artificial Sequence
  Synthetic construct
gcaguagaugcggaaguua

SEQ ID NO: 1475 - RNA, 19 nt, Artificial Sequence
  Synthetic construct
gcaagucagauucugauau

SEQ ID NO: 1476 - RNA, 19 nt, Artificial Sequence
  Synthetic construct
gcuucaagauugguggcuu

SEQ ID NO: 1477 - RNA, 19 nt, Artificial Sequence
  Synthetic construct
ccgagaagcuagaucuuaa

SEQ ID NO: 1478 - RNA, 19 nt, Artificial Sequence
  Synthetic construct
ccaaagacauuggacacuu

SEQ ID NO: 1479 - RNA, 19 nt, Artificial Sequence
  Synthetic construct
ggugguuauuggagaucau

SEQ ID NO: 1480 - RNA, 19 nt, Artificial Sequence
  Synthetic construct
gcugcagcaucugagauua

SEQ ID NO: 1481 - RNA, 19 nt, Artificial Sequence
  Synthetic construct
gcgcuuauacagauuacua

SEQ ID NO: 1482 - RNA, 19 nt, Artificial Sequence
  Synthetic construct
ccaguacgcaagugggaaa

SEQ ID NO: 1483 - RNA, 19 nt, Artificial Sequence
  Synthetic construct
gcaggaaagagagaauuau

SEQ ID NO: 1484 - RNA, 19 nt, Artificial Sequence
  Synthetic construct
ccaguuacagccuuaucuu

SEQ ID NO: 1485 - RNA, 19 nt, Artificial Sequence
  Synthetic construct
gcugugauucugagucaaa

SEQ ID NO: 1486 - RNA, 19 nt, Artificial Sequence
  Synthetic construct
ccucuuucacuccaucaaa

SEQ ID NO: 1487 - RNA, 19 nt, Artificial Sequence
  Synthetic construct
ccaucaaagaacucacuuu

SEQ ID NO: 1488 - RNA, 19 nt, Artificial Sequence
  Synthetic construct
gcuaagaaagugcaguuaa

SEQ ID NO: 1489 - RNA, 19 nt, Artificial Sequence
  Synthetic construct
ccaacugugaccgauuuaa

SEQ ID NO: 1490 - RNA, 19 nt, Artificial Sequence
  Synthetic construct
ccauaugcuggagagacau

SEQ ID NO: 1491 - RNA, 19 nt, Artificial Sequence
  Synthetic construct
ccuccuggaauccuucaaa

SEQ ID NO: 1492 - RNA, 19 nt, Artificial Sequence
  Synthetic construct
ggugaaggaacuugugcaa

SEQ ID NO: 1493 - RNA, 19 nt, Artificial Sequence
  Synthetic construct
ccguagauuucagcaauau

SEQ ID NO: 1494 - RNA, 19 nt, Artificial Sequence
  Synthetic construct
ccuucucaaggauguaaau

SEQ ID NO: 1495 - RNA, 19 nt, Artificial Sequence
  Synthetic construct
ggugcaguacgugauucaa

SEQ ID NO: 1496 - RNA, 19 nt, Artificial Sequence
  Synthetic construct
gcacaggugucguggaaua

SEQ ID NO: 1497 - RNA, 19 nt, Artificial Sequence
  Synthetic construct
ccagccaacucucacauuu

SEQ ID NO: 1498 - RNA, 19 nt, Artificial Sequence
  Synthetic construct
ccguuuaucacuuuaccaa

SEQ ID NO: 1499 - RNA, 19 nt, Artificial Sequence
  Synthetic construct
gcaucagaagccagugcua

SEQ ID NO: 1500 - RNA, 19 nt, Artificial Sequence
  Synthetic construct
ccuugaagcuguagccaaa

SEQ ID NO: 1501 - RNA, 19 nt, Artificial Sequence
  Synthetic construct
gcuaugcagacacacucuu

SEQ ID NO: 1502 - RNA, 19 nt, Artificial Sequence
  Synthetic construct
gcagacacacucuucgaua

SEQ ID NO: 1503 - RNA, 19 nt, Artificial Sequence
  Synthetic construct
gcauagaugauggugacaa

SEQ ID NO: 1504 - RNA, 19 nt, Artificial Sequence
  Synthetic construct
gcaggucuuaaggagcuuu

SEQ ID NO: 1505 - RNA, 19 nt, Artificial Sequence
  Synthetic construct
ggagcgucuuucucaggaa

SEQ ID NO: 1506 - RNA, 19 nt, Artificial Sequence
  Synthetic construct
gguggugcuuuaugucaaa

SEQ ID NO: 1507 - RNA, 19 nt, Artificial Sequence
  Synthetic construct
gcuacgacaacauccauuu

SEQ ID NO: 1508 - RNA, 19 nt, Artificial Sequence
  Synthetic construct
ccauuucaugaaagccuuu

SEQ ID NO: 1509 - RNA, 19 nt, Artificial Sequence
  Synthetic construct
ggcaaguuggagagccuuu

SEQ ID NO: 1510 - RNA, 19 nt, Artificial Sequence
  Synthetic construct
gcaaguuggagagccuuug

SEQ ID NO: 1511 - RNA, 19 nt, Artificial Sequence
  Synthetic construct
uagagacacuggcuggauu

SEQ ID NO: 1512 - RNA, 19 nt, Artificial Sequence
  Synthetic construct
gaaggcucaaacaacccaa

SEQ ID NO: 1513 - RNA, 19 nt, Artificial Sequence
  Synthetic construct
gcucaaacaacccaaggcu

SEQ ID NO: 1514 - RNA, 19 nt, Artificial Sequence
  Synthetic construct
cucaaacaacccaaggcuu

SEQ ID NO: 1515 - RNA, 19 nt, Artificial Sequence
  Synthetic construct
ucaaacaacccaaggcuuu

SEQ ID NO: 1516 - RNA, 19 nt, Artificial Sequence
  Synthetic construct
ggaaggaccugcugaugaa

SEQ ID NO: 1517 - RNA, 19 nt, Artificial Sequence
  Synthetic construct
gcauaucacugcauacaaa

SEQ ID NO: 1518 - RNA, 19 nt, Artificial Sequence
  Synthetic construct
ccuacagcuuugguauauu

SEQ ID NO: 1519 - RNA, 19 nt, Artificial Sequence
  Synthetic construct
gcaguguagggcagaguau

SEQ ID NO: 1520 - RNA, 19 nt, Artificial Sequence
  Synthetic construct
gcagcccauuucaagacuu

SEQ ID NO: 1521 - RNA, 19 nt, Artificial Sequence
  Synthetic construct
ccuguugaugcagcucuaa

SEQ ID NO: 1522 - RNA, 19 nt, Artificial Sequence
  Synthetic construct
gccuggcuuuagcucagau

SEQ ID NO: 1523 - RNA, 19 nt, Artificial Sequence
  Synthetic construct
ccugcacaagaaagcuauu

SEQ ID NO: 1524 - RNA, 19 nt, Artificial Sequence
  Synthetic construct
gcacaagaaagcuauucuu

SEQ ID NO: 1525 - RNA, 19 nt, Artificial Sequence
  Synthetic construct
gcaagaaguggcaaauaua

SEQ ID NO: 1526 - RNA, 19 nt, Artificial Sequence
  Synthetic construct
ggaucuuccuguaaaugau

SEQ ID NO: 1527 - RNA, 19 nt, Artificial Sequence
  Synthetic construct
ccauuggucccucuugauu

SEQ ID NO: 1528 - RNA, 19 nt, Artificial Sequence
  Synthetic construct
gccagugaguguuaaugaa

SEQ ID NO: 1529 - RNA, 19 nt, Artificial Sequence
  Synthetic construct
cccugcauuuggcugugaa

SEQ ID NO: 1530 - RNA, 19 nt, Artificial Sequence
  Synthetic construct
gcugugaacuacauugaua

SEQ ID NO: 1531 - RNA, 19 nt, Artificial Sequence
  Synthetic construct
gcuguuagccucaaaguuu

SEQ ID NO: 1532 - RNA, 19 nt, Artificial Sequence
  Synthetic construct
gcagaguuuguguacauua

SEQ ID NO: 1533 - RNA, 19 nt, Artificial Sequence
  Synthetic construct
gcagccugcaaacugcaaa

SEQ ID NO: 1534 - RNA, 19 nt, Artificial Sequence
  Synthetic construct
gccugcaaacugcaaaguu

SEQ ID NO: 1535 - RNA, 19 nt, Artificial Sequence
  Synthetic construct
gcaaacugcaaaguugaaa

SEQ ID NO: 1536 - RNA, 19 nt, Artificial Sequence
  Synthetic construct
gcagcuacguauccaucgu

SEQ ID NO: 1537 - RNA, 19 nt, Artificial Sequence
  Synthetic construct
gcuacguauccaucgugau

SEQ ID NO: 1538 - RNA, 19 nt, Artificial Sequence
  Synthetic construct
uccaucgugauggcaucua

SEQ ID NO: 1539 - RNA, 19 nt, Artificial Sequence
  Synthetic construct
ccaucgugauggcaucuac

SEQ ID NO: 1540 - RNA, 19 nt, Artificial Sequence
  Synthetic construct
ugauggcaucuacauggua

SEQ ID NO: 1541 - RNA, 19 nt, Artificial Sequence
  Synthetic construct
ggcaucuacaugguacaca

SEQ ID NO: 1542 - RNA, 19 nt, Artificial Sequence
  Synthetic construct
gcaucuacaugguacacau

SEQ ID NO: 1543 - RNA, 19 nt, Artificial Sequence
  Synthetic construct
cucagcuuccaccaagguu

SEQ ID NO: 1544 - RNA, 19 nt, Artificial Sequence
  Synthetic construct
ucagcuuccaccaagguug

SEQ ID NO: 1545 - RNA, 19 nt, Artificial Sequence
  Synthetic construct
gccuucccgaaacacugau

SEQ ID NO: 1546 - RNA, 19 nt, Artificial Sequence
  Synthetic construct
gcuugugugcuuagccuca

SEQ ID NO: 1547 - RNA, 19 nt, Artificial Sequence
  Synthetic construct
gccucauuuccaccaucua

SEQ ID NO: 1548 - RNA, 19 nt, Artificial Sequence
  Synthetic construct
ucauuuccaccaucuacau

SEQ ID NO: 1549 - RNA, 19 nt, Artificial Sequence
  Synthetic construct
ucuacauggcagccuccau

SEQ ID NO: 1550 - RNA, 19 nt, Artificial Sequence
  Synthetic construct
ccuccauuggcacagacuu

SEQ ID NO: 1551 - RNA, 19 nt, Artificial Sequence
  Synthetic construct
gcaucugggaugaauucau

SEQ ID NO: 1552 - RNA, 19 nt, Artificial Sequence
  Synthetic construct
ggauuguggagacggugua

SEQ ID NO: 1553 - RNA, 19 nt, Artificial Sequence
  Synthetic construct
gauuguggagacgguguau

SEQ ID NO: 1554 - RNA, 19 nt, Artificial Sequence
  Synthetic construct
ggagacgguguaucaccau

SEQ ID NO: 1555 - RNA, 19 nt, Artificial Sequence
  Synthetic construct
gcauugguauagcccacca

SEQ ID NO: 1556 - RNA, 19 nt, Artificial Sequence
  Synthetic construct
gcacgaacaugcaguuauu

SEQ ID NO: 1557 - RNA, 19 nt, Artificial Sequence
  Synthetic construct
ggagacacuccaccacaaa

SEQ ID NO: 1558 - RNA, 19 nt, Artificial Sequence
  Synthetic construct
cccucaccauuguguccau

SEQ ID NO: 1559 - RNA, 19 nt, Artificial Sequence
  Synthetic construct
ccucaccauuguguccauu

SEQ ID NO: 1560 - RNA, 19 nt, Artificial Sequence
  Synthetic construct
gaauauuaccaccagagaa

SEQ ID NO: 1561 - RNA, 19 nt, Artificial Sequence
  Synthetic construct
ccaccagagaagagagcuu

SEQ ID NO: 1562 - RNA, 19 nt, Artificial Sequence
  Synthetic construct
gcauuuauccuucauacca

SEQ ID NO: 1563 - RNA, 19 nt, Artificial Sequence
  Synthetic construct
gcaccugauacucugucua

SEQ ID NO: 1564 - RNA, 19 nt, Artificial Sequence
  Synthetic construct
ccugauacucugucuaaau

SEQ ID NO: 1565 - RNA, 19 nt, Artificial Sequence
  Synthetic construct
gcacuuccuggaguuaaau

SEQ ID NO: 1566 - RNA, 21 nt, Artificial Sequence
  Synthetic construct
gauucuaccagaaaggaauga

SEQ ID NO: 1567 - RNA, 21 nt, Artificial Sequence
  Synthetic construct
gagucacaaugcagacaaaua

SEQ ID NO: 1568 - RNA, 21 nt, Artificial Sequence
  Synthetic construct
gggagauuguugcaaggaaga

SEQ ID NO: 1569 - RNA, 21 nt, Artificial Sequence
  Synthetic construct
ggcuagaagagccaaccaaca

SEQ ID NO: 1570 - RNA, 21 nt, Artificial Sequence
  Synthetic construct
gaagggaaagcagucuguucu

SEQ ID NO: 1571 - RNA, 21 nt, Artificial Sequence
  Synthetic construct
gaaagcagucuguucugaaca

SEQ ID NO: 1572 - RNA, 21 nt, Artificial Sequence
  Synthetic construct
gcagucuguucugaacauagg

SEQ ID NO: 1573 - RNA, 21 nt, Artificial Sequence
  Synthetic construct
gccaaguaucuuuccagcaug

SEQ ID NO: 1574 - RNA, 21 nt, Artificial Sequence
  Synthetic construct
gcauguuucucccauuuagaa

SEQ ID NO: 1575 - RNA, 21 nt, Artificial Sequence
  Synthetic construct
gcauguaaggccuuucaauau

SEQ ID NO: 1576 - RNA, 21 nt, Artificial Sequence
  Synthetic construct
ggugagaacugacuaaacuac

SEQ ID NO: 1577 - RNA, 21 nt, Artificial Sequence
  Synthetic construct
gcacagggauugucaacauuc

SEQ ID NO: 1578 - RNA, 21 nt, Artificial Sequence
  Synthetic construct
gcuguugagaccagcugaaau

SEQ ID NO: 1579 - RNA, 21 nt, Artificial Sequence
  Synthetic construct
gagaccagcugaaauguuuga

SEQ ID NO: 1580 - RNA, 21 nt, Artificial Sequence
  Synthetic construct
gaagcaaccaagucuacaaag

SEQ ID NO: 1581 - RNA, 21 nt, Artificial Sequence
  Synthetic construct
ggcacaguuugacucaaaugg

SEQ ID NO: 1582 - RNA, 21 nt, Artificial Sequence
  Synthetic construct
ggauccaacugauuagcaaau

SEQ ID NO: 1583 - RNA, 21 nt, Artificial Sequence
  Synthetic construct
gcauagcagcuccaagucauc

SEQ ID NO: 1584 - RNA, 21 nt, Artificial Sequence
  Synthetic construct
gcuccaagucaucccuaauga

SEQ ID NO: 1585 - RNA, 21 nt, Artificial Sequence
  Synthetic construct
gacuuaaagucauagccuuug

SEQ ID NO: 1586 - RNA, 21 nt, Artificial Sequence
  Synthetic construct
gcaaugguacuguaauugagc

SEQ ID NO: 1587 - RNA, 21 nt, Artificial Sequence
  Synthetic construct
gguacuguaauugagcauccg

SEQ ID NO: 1588 - RNA, 21 nt, Artificial Sequence
  Synthetic construct
guaauugagcauccggaauau

SEQ ID NO: 1589 - RNA, 21 nt, Artificial Sequence
  Synthetic construct
agggugaccaacgcaagaaca

SEQ ID NO: 1590 - RNA, 21 nt, Artificial Sequence
  Synthetic construct
ggugaccaacgcaagaacaua

SEQ ID NO: 1591 - RNA, 21 nt, Artificial Sequence
  Synthetic construct
gugaccaacgcaagaacauau

SEQ ID NO: 1592 - RNA, 21 nt, Artificial Sequence
  Synthetic construct
gaccaacgcaagaacauaugc

SEQ ID NO: 1593 - RNA, 21 nt, Artificial Sequence
  Synthetic construct
gcaagaacauaugccaguucc

SEQ ID NO: 1594 - RNA, 21 nt, Artificial Sequence
  Synthetic construct
gccaguuccucguagagauug

SEQ ID NO: 1595 - RNA, 21 nt, Artificial Sequence
  Synthetic construct
ggacgaucagcugaagguuca

SEQ ID NO: 1596 - RNA, 21 nt, Artificial Sequence
  Synthetic construct
ggaguuccuccaguucuauga

SEQ ID NO: 1597 - RNA, 21 nt, Artificial Sequence
  Synthetic construct
gcucauuggcaacuccuuacc

SEQ ID NO: 1598 - RNA, 21 nt, Artificial Sequence
  Synthetic construct
gcauccuuaugcgcgucacua

SEQ ID NO: 1599 - RNA, 21 nt, Artificial Sequence
  Synthetic construct
ggcacugcaacaauggaaucc

SEQ ID NO: 1600 - RNA, 21 nt, Artificial Sequence
  Synthetic construct
gaacugacauggaccaaauua

SEQ ID NO: 1601 - RNA, 21 nt, Artificial Sequence
  Synthetic construct
gauccacaugcgggagcaaau

SEQ ID NO: 1602 - RNA, 21 nt, Artificial Sequence
  Synthetic construct
gcaaauggacaaugccgugua

SEQ ID NO: 1603 - RNA, 21 nt, Artificial Sequence
  Synthetic construct
gcgggugcugaagaaauacga

SEQ ID NO: 1604 - RNA, 21 nt, Artificial Sequence
  Synthetic construct
gcugaagaaauacgacuacga

SEQ ID NO: 1605 - RNA, 21 nt, Artificial Sequence
  Synthetic construct
gcugaucuucgaggacuuugc

SEQ ID NO: 1606 - RNA, 21 nt, Artificial Sequence
  Synthetic construct
gcugugacugcaaggacuugu

SEQ ID NO: 1607 - RNA, 21 nt, Artificial Sequence
  Synthetic construct
gacugcaaggacuugucuuac

SEQ ID NO: 1608 - RNA, 21 nt, Artificial Sequence
  Synthetic construct
gcaaggacuugucuuacaagg

SEQ ID NO: 1609 - RNA, 21 nt, Artificial Sequence
  Synthetic construct
gaaacucacugguggacaagc

SEQ ID NO: 1610 - RNA, 21 nt, Artificial Sequence
  Synthetic construct
gcucuguacagacugcuauuc

SEQ ID NO: 1611 - RNA, 21 nt, Artificial Sequence
  Synthetic construct
ggcaugagaccugcuucaucu

SEQ ID NO: 1612 - RNA, 21 nt, Artificial Sequence
  Synthetic construct
gcagccaauuggaaccaagag

SEQ ID NO: 1613 - RNA, 21 nt, Artificial Sequence
  Synthetic construct
ggcauaacgacugcuuuaacu

SEQ ID NO: 1614 - RNA, 21 nt, Artificial Sequence
  Synthetic construct
gcauaacgacugcuuuaacug

SEQ ID NO: 1615 - RNA, 21 nt, Artificial Sequence
  Synthetic construct
gcuuuaacuguaagaagugcu

SEQ ID NO: 1616 - RNA, 21 nt, Artificial Sequence
  Synthetic construct
ggacgaugaggaugaagaaau

SEQ ID NO: 1617 - RNA, 21 nt, Artificial Sequence
  Synthetic construct
gacgaugaggaugaagaaaug

SEQ ID NO: 1618 - RNA, 21 nt, Artificial Sequence
  Synthetic construct
gcugcaacauaaauuccagga

SEQ ID NO: 1619 - RNA, 21 nt, Artificial Sequence
  Synthetic construct
gcaacauaaauuccaggagcg

SEQ ID NO: 1620 - RNA, 21 nt, Artificial Sequence
  Synthetic construct
gcagcaggagcuauugcugaa

SEQ ID NO: 1621 - RNA, 21 nt, Artificial Sequence
  Synthetic construct
gcaggagcuauugcugaaguu

SEQ ID NO: 1622 - RNA, 21 nt, Artificial Sequence
  Synthetic construct
gcuauugcugaaguugcuaca

SEQ ID NO: 1623 - RNA, 21 nt, Artificial Sequence
  Synthetic construct
gacucauacagccaccuaucg

SEQ ID NO: 1624 - RNA, 21 nt, Artificial Sequence
  Synthetic construct
gcuggaagccaaagaauuugc

SEQ ID NO: 1625 - RNA, 21 nt, Artificial Sequence
  Synthetic construct
gccaaagaauuugccaaacaa

SEQ ID NO: 1626 - RNA, 21 nt, Artificial Sequence
  Synthetic construct
ggguggaauugaugaagaaau

SEQ ID NO: 1627 - RNA, 21 nt, Artificial Sequence
  Synthetic construct
gcucauacguuagcgcuaaau

SEQ ID NO: 1628 - RNA, 21 nt, Artificial Sequence
  Synthetic construct
gcaucagaguacccagaaaua

SEQ ID NO: 1629 - RNA, 21 nt, Artificial Sequence
  Synthetic construct
gcuugugguuacuaucauuca

SEQ ID NO: 1630 - RNA, 21 nt, Artificial Sequence
  Synthetic construct
gcugcuuaagucuuugcuugg

SEQ ID NO: 1631 - RNA, 21 nt, Artificial Sequence
  Synthetic construct
gcagaucuggacagugaauga

SEQ ID NO: 1632 - RNA, 21 nt, Artificial Sequence
  Synthetic construct
gccaaugagauagauggaacg

SEQ ID NO: 1633 - RNA, 21 nt, Artificial Sequence
  Synthetic construct
gcagauaucccuguuacaauc

SEQ ID NO: 1634 - RNA, 21 nt, Artificial Sequence
  Synthetic construct
gcucaucaugagggaauuauu

SEQ ID NO: 1635 - RNA, 21 nt, Artificial Sequence
  Synthetic construct
ggagaagcaugcaacaguuac

SEQ ID NO: 1636 - RNA, 21 nt, Artificial Sequence
  Synthetic construct
gguggacagguuccuguauca

SEQ ID NO: 1637 - RNA, 21 nt, Artificial Sequence
  Synthetic construct
ggaguuccuuucccuggaucu

SEQ ID NO: 1638 - RNA, 21 nt, Artificial Sequence
  Synthetic construct
gcacagagcuguuugaauaug

SEQ ID NO: 1639 - RNA, 21 nt, Artificial Sequence
  Synthetic construct
gcugacugucuggcagauuuc

SEQ ID NO: 1640 - RNA, 21 nt, Artificial Sequence
  Synthetic construct
ggaagaggguguccuacuuuc

SEQ ID NO: 1641 - RNA, 21 nt, Artificial Sequence
  Synthetic construct
gcgaaguuggugucaucaucg

SEQ ID NO: 1642 - RNA, 21 nt, Artificial Sequence
  Synthetic construct
gcugccauggagaaguauaaa

SEQ ID NO: 1643 - RNA, 21 nt, Artificial Sequence
  Synthetic construct
gcacaagguggugaggaaacu

SEQ ID NO: 1644 - RNA, 21 nt, Artificial Sequence
  Synthetic construct
ggucagugcgaauguacaaca

SEQ ID NO: 1645 - RNA, 21 nt, Artificial Sequence
  Synthetic construct
gcagcaacaugugcuacaugg

SEQ ID NO: 1646 - RNA, 21 nt, Artificial Sequence
  Synthetic construct
gauugaucagaacagagaugg

SEQ ID NO: 1647 - RNA, 21 nt, Artificial Sequence
  Synthetic construct
gaucagaacagagaugguuuc

SEQ ID NO: 1648 - RNA, 21 nt, Artificial Sequence
  Synthetic construct
gagaugguuucaucgacaagg

SEQ ID NO: 1649 - RNA, 21 nt, Artificial Sequence
  Synthetic construct
gguuucaucgacaaggaagau

SEQ ID NO: 1650 - RNA, 21 nt, Artificial Sequence
  Synthetic construct
aggaagauuugcaugauaugc

SEQ ID NO: 1651 - RNA, 21 nt, Artificial Sequence
  Synthetic construct
gcaugauaugcuugcuucauu

SEQ ID NO: 1652 - RNA, 21 nt, Artificial Sequence
  Synthetic construct
ggaagaauccaacugaugagu

SEQ ID NO: 1653 - RNA, 21 nt, Artificial Sequence
  Synthetic construct
gaauccaacugaugaguaucu

SEQ ID NO: 1654 - RNA, 21 nt, Artificial Sequence
  Synthetic construct
guucacacgcauccugaaaca

SEQ ID NO: 1655 - RNA, 21 nt, Artificial Sequence
  Synthetic construct
ggagccaaagacaaagaugac

SEQ ID NO: 1656 - RNA, 21 nt, Artificial Sequence
  Synthetic construct
ggaaguaugcuguucucuauc

SEQ ID NO: 1657 - RNA, 21 nt, Artificial Sequence
  Synthetic construct
gaaguaugcuguucucuauca

SEQ ID NO: 1658 - RNA, 21 nt, Artificial Sequence
  Synthetic construct
gccucuauuugauaagcgauu

SEQ ID NO: 1659 - RNA, 21 nt, Artificial Sequence
  Synthetic construct
gaugagauuucggaggaauug

SEQ ID NO: 1660 - RNA, 21 nt, Artificial Sequence
  Synthetic construct
gauuucggaggaauugaaaga

SEQ ID NO: 1661 - RNA, 21 nt, Artificial Sequence
  Synthetic construct
gcugaagcuauccuugcugca

SEQ ID NO: 1662 - RNA, 21 nt, Artificial Sequence
  Synthetic construct
gcuauccuugcugcagacuuc

SEQ ID NO: 1663 - RNA, 21 nt, Artificial Sequence
  Synthetic construct
gcugcagacuucgaaauuggu

SEQ ID NO: 1664 - RNA, 21 nt, Artificial Sequence
  Synthetic construct
gagcguauaaucccaagauca

SEQ ID NO: 1665 - RNA, 21 nt, Artificial Sequence
  Synthetic construct
gcguauaaucccaagaucagu

SEQ ID NO: 1666 - RNA, 21 nt, Artificial Sequence
  Synthetic construct
gcaggagaauguguuccuucc

SEQ ID NO: 1667 - RNA, 21 nt, Artificial Sequence
  Synthetic construct
gcugacguggugccuauuaac

SEQ ID NO: 1668 - RNA, 21 nt, Artificial Sequence
  Synthetic construct
ggagacaugaauggcacuuuc

SEQ ID NO: 1669 - RNA, 21 nt, Artificial Sequence
  Synthetic construct
gcaauagcagugauggcuuug

SEQ ID NO: 1670 - RNA, 21 nt, Artificial Sequence
  Synthetic construct
gguccaauuaccaggauaaau

SEQ ID NO: 1671 - RNA, 21 nt, Artificial Sequence
  Synthetic construct
ggugguucagucaaaccaaag

SEQ ID NO: 1672 - RNA, 21 nt, Artificial Sequence
  Synthetic construct
ggaacaacgaacuccaguugc

SEQ ID NO: 1673 - RNA, 21 nt, Artificial Sequence
  Synthetic construct
gcuccacaguaccacuuaaag

SEQ ID NO: 1674 - RNA, 21 nt, Artificial Sequence
  Synthetic construct
ggucgauucagagaagcaucc

SEQ ID NO: 1675 - RNA, 21 nt, Artificial Sequence
  Synthetic construct
gcaccagcagugacaacuuca

SEQ ID NO: 1676 - RNA, 19 nt, Artificial Sequence
  Synthetic construct
gcagagguuccaagaccaa

SEQ ID NO: 1677 - RNA, 19 nt, Artificial Sequence
  Synthetic construct
gggccugauuacauuccaa

SEQ ID NO: 1678 - RNA, 19 nt, Artificial Sequence
  Synthetic construct
gguucagaucugugccuuu

SEQ ID NO: 1679 - RNA, 19 nt, Artificial Sequence
  Synthetic construct
gccuuuggcugcaacaagu

SEQ ID NO: 1680 - RNA, 19 nt, Artificial Sequence
  Synthetic construct
gguuccaucccuaaacuua

SEQ ID NO: 1681 - RNA, 19 nt, Artificial Sequence
  Synthetic construct
gcuuguaucaugggauacu

SEQ ID NO: 1682 - RNA, 19 nt, Artificial Sequence
  Synthetic construct
ggacaagcacgacgaucuu

SEQ ID NO: 1683 - RNA, 19 nt, Artificial Sequence
  Synthetic construct
gcagcagacaacauagaaa

SEQ ID NO: 1684 - RNA, 19 nt, Artificial Sequence
  Synthetic construct
ccaauuccauucaguucuu

SEQ ID NO: 1685 - RNA, 19 nt, Artificial Sequence
  Synthetic construct
gaucccaaccuugaagaaa

SEQ ID NO: 1686 - RNA, 19 nt, Artificial Sequence
  Synthetic construct
ggugaccgaacuagcaguu

SEQ ID NO: 1687 - RNA, 19 nt, Artificial Sequence
  Synthetic construct
gcaguugcccagugaucuu

SEQ ID NO: 1688 - RNA, 19 nt, Artificial Sequence
  Synthetic construct
gcaguuauuggucuuacau

SEQ ID NO: 1689 - RNA, 19 nt, Artificial Sequence
  Synthetic construct
ggcagauacacuuaaugaa

SEQ ID NO: 1690 - RNA, 19 nt, Artificial Sequence
  Synthetic construct
gcggucauuacacaugcua

SEQ ID NO: 1691 - RNA, 19 nt, Artificial Sequence
  Synthetic construct
ggucauuacacaugcuauu

SEQ ID NO: 1692 - RNA, 19 nt, Artificial Sequence
  Synthetic construct
gcuauugaugcuugcuuua

SEQ ID NO: 1693 - RNA, 19 nt, Artificial Sequence
  Synthetic construct
gcauggacucgaaagcaaa

SEQ ID NO: 1694 - RNA, 19 nt, Artificial Sequence
  Synthetic construct
ggacucgaaagcaaauauu

SEQ ID NO: 1695 - RNA, 19 nt, Artificial Sequence
  Synthetic construct
ggaaagaacuucaggaaau

SEQ ID NO: 1696 - RNA, 19 nt, Artificial Sequence
  Synthetic construct
ggcucauucaccaccguaa

SEQ ID NO: 1697 - RNA, 19 nt, Artificial Sequence
  Synthetic construct
gcucauucaccaccguaaa

SEQ ID NO: 1698 - RNA, 19 nt, Artificial Sequence
  Synthetic construct
gcaccuuggaagaguguua

SEQ ID NO: 1699 - RNA, 19 nt, Artificial Sequence
  Synthetic construct
gccuaggaagcgaacuuau

SEQ ID NO: 1700 - RNA, 19 nt, Artificial Sequence
  Synthetic construct
gcgaacuuaugaacagaua

SEQ ID NO: 1701 - RNA, 19 nt, Artificial Sequence
  Synthetic construct
gcagauuacaauggcagau

SEQ ID NO: 1702 - RNA, 19 nt, Artificial Sequence
  Synthetic construct
gcagauuggcggcagaaau

SEQ ID NO: 1703 - RNA, 19 nt, Artificial Sequence
  Synthetic construct
ggcggcagaaauagaugau

SEQ ID NO: 1704 - RNA, 19 nt, Artificial Sequence
  Synthetic construct
gcggcagaaauagaugaua

SEQ ID NO: 1705 - RNA, 19 nt, Artificial Sequence
  Synthetic construct
gcaacucacucgaauguua

SEQ ID NO: 1706 - RNA, 19 nt, Artificial Sequence
  Synthetic construct
uccaguggaauacacccuu

SEQ ID NO: 1707 - RNA, 19 nt, Artificial Sequence
  Synthetic construct
ccaguggaauacacccuua

SEQ ID NO: 1708 - RNA, 19 nt, Artificial Sequence
  Synthetic construct
gcgugcucugagaucuaca

SEQ ID NO: 1709 - RNA, 19 nt, Artificial Sequence
  Synthetic construct
gcucugagaucuacauuca

SEQ ID NO: 1710 - RNA, 19 nt, Artificial Sequence
  Synthetic construct
ucaaccgcgccaucaacau

SEQ ID NO: 1711 - RNA, 19 nt, Artificial Sequence
  Synthetic construct
gcuuguugaugagcuggag

SEQ ID NO: 1712 - RNA, 19 nt, Artificial Sequence
  Synthetic construct
uccgcaacaacucagccau

SEQ ID NO: 1713 - RNA, 19 nt, Artificial Sequence
  Synthetic construct
gcaacaacucagccaucca

SEQ ID NO: 1714 - RNA, 19 nt, Artificial Sequence
  Synthetic construct
ccauccacauccgagucuu

SEQ ID NO: 1715 - RNA, 19 nt, Artificial Sequence
  Synthetic construct
ucuucagggucacacccaa

SEQ ID NO: 1716 - RNA, 19 nt, Artificial Sequence
  Synthetic construct
gcggagaacaauugaggau

SEQ ID NO: 1717 - RNA, 19 nt, Artificial Sequence
  Synthetic construct
ggagaacaauugaggauuu

SEQ ID NO: 1718 - RNA, 19 nt, Artificial Sequence
  Synthetic construct
ggcauaugcugguuacauu

SEQ ID NO: 1719 - RNA, 19 nt, Artificial Sequence
  Synthetic construct
gcucaaggacucucucuuu

SEQ ID NO: 1720 - RNA, 19 nt, Artificial Sequence
  Synthetic construct
ucucccauccuccucgaaa

SEQ ID NO: 1721 - RNA, 19 nt, Artificial Sequence
  Synthetic construct
cccauccuccucgaaagaa

SEQ ID NO: 1722 - RNA, 19 nt, Artificial Sequence
  Synthetic construct
ccucgaaagaaggaccgaa

SEQ ID NO: 1723 - RNA, 19 nt, Artificial Sequence
  Synthetic construct
ccucuccugugcuaagauu

SEQ ID NO: 1724 - RNA, 19 nt, Artificial Sequence
  Synthetic construct
ucuccugugcuaagauuaa

SEQ ID NO: 1725 - RNA, 19 nt, Artificial Sequence
  Synthetic construct
gccagaaaugcaaggaacu

SEQ ID NO: 1726 - RNA, 19 nt, Artificial Sequence
  Synthetic construct
ccuuguagagccaagcaaa

SEQ ID NO: 1727 - RNA, 19 nt, Artificial Sequence
  Synthetic construct
gccaggaagcuauuuccaa

SEQ ID NO: 1728 - RNA, 19 nt, Artificial Sequence
  Synthetic construct
ccaggaagcuauuuccaaa

SEQ ID NO: 1729 - RNA, 19 nt, Artificial Sequence
  Synthetic construct
ggaagcuauuuccaaagaa

SEQ ID NO: 1730 - RNA, 19 nt, Artificial Sequence
  Synthetic construct
gcuauuuccaaagaaccua

SEQ ID NO: 1731 - RNA, 19 nt, Artificial Sequence
  Synthetic construct
gcagcuuaccgauguccuu

SEQ ID NO: 1732 - RNA, 19 nt, Artificial Sequence
  Synthetic construct
gccuuugacugagagugaa

SEQ ID NO: 1733 - RNA, 19 nt, Artificial Sequence
  Synthetic construct
ggauaggacuauucuugau

SEQ ID NO: 1734 - RNA, 19 nt, Artificial Sequence
  Synthetic construct
gguagcacaugacauacau

SEQ ID NO: 1735 - RNA, 19 nt, Artificial Sequence
  Synthetic construct
ccuaagcaauggcuaacuu

SEQ ID NO: 1736 - RNA, 19 nt, Artificial Sequence
  Synthetic construct
gcugcaucucuccuacaau

SEQ ID NO: 1737 - RNA, 19 nt, Artificial Sequence
  Synthetic construct
gcaaagaacaguggucaau

SEQ ID NO: 1738 - RNA, 19 nt, Artificial Sequence
  Synthetic construct
gcacgcuuagauuggaaua

SEQ ID NO: 1739 - RNA, 19 nt, Artificial Sequence
  Synthetic construct
ggauuucgaugucagacuu

SEQ ID NO: 1740 - RNA, 19 nt, Artificial Sequence
  Synthetic construct
gcaccaaaguaccuacuau

SEQ ID NO: 1741 - RNA, 19 nt, Artificial Sequence
  Synthetic construct
gcacuaccuucuuugacua

SEQ ID NO: 1742 - RNA, 19 nt, Artificial Sequence
  Synthetic construct
ggucgacauccacaccuaa

SEQ ID NO: 1743 - RNA, 19 nt, Artificial Sequence
  Synthetic construct
ccucguggacagagagauu

SEQ ID NO: 1744 - RNA, 19 nt, Artificial Sequence
  Synthetic construct
ggaaauagaagccagugaa

SEQ ID NO: 1745 - RNA, 19 nt, Artificial Sequence
  Synthetic construct
gggaauggacuauuugcau

SEQ ID NO: 1746 - RNA, 19 nt, Artificial Sequence
  Synthetic construct
gaaagaaagcgaaguagaa

SEQ ID NO: 1747 - RNA, 19 nt, Artificial Sequence
  Synthetic construct
ucaagaagucgagaucgaa

SEQ ID NO: 1748 - RNA, 19 nt, Artificial Sequence
  Synthetic construct
gguugccucauagcaucaa

SEQ ID NO: 1749 - RNA, 19 nt, Artificial Sequence
  Synthetic construct
gccucauagcaucaaauua

SEQ ID NO: 1750 - RNA, 19 nt, Artificial Sequence
  Synthetic construct
gcaucaaauuaagcagacg

SEQ ID NO: 1751 - RNA, 19 nt, Artificial Sequence
  Synthetic construct
gcagcaauggcaaacaauu

SEQ ID NO: 1752 - RNA, 19 nt, Artificial Sequence
  Synthetic construct
gcuggaccuaugaggcuuu

SEQ ID NO: 1753 - RNA, 19 nt, Artificial Sequence
  Synthetic construct
ggcuuuaugugggcucauu

SEQ ID NO: 1754 - RNA, 19 nt, Artificial Sequence
  Synthetic construct
gcuuuaugugggcucauua

SEQ ID NO: 1755 - RNA, 19 nt, Artificial Sequence
  Synthetic construct
gcucauuacacuucaacau

SEQ ID NO: 1756 - RNA, 19 nt, Artificial Sequence
  Synthetic construct
gcuccuuccgggacaauaa

SEQ ID NO: 1757 - RNA, 19 nt, Artificial Sequence
  Synthetic construct
gggacaauaacggugugau

SEQ ID NO: 1758 - RNA, 19 nt, Artificial Sequence
  Synthetic construct
ggacaauaacggugugauu

SEQ ID NO: 1759 - RNA, 19 nt, Artificial Sequence
  Synthetic construct
ccucaggaaacgaccacuu

SEQ ID NO: 1760 - RNA, 19 nt, Artificial Sequence
  Synthetic construct
gccgugugccugaguuauu

SEQ ID NO: 1761 - RNA, 19 nt, Artificial Sequence
  Synthetic construct
ccgugugccugaguuauuu

SEQ ID NO: 1762 - RNA, 19 nt, Artificial Sequence
  Synthetic construct
gcacagaaucuugcuucau

SEQ ID NO: 1763 - RNA, 19 nt, Artificial Sequence
  Synthetic construct
ccuaacauccuucaagaau

SEQ ID NO: 1764 - RNA, 19 nt, Artificial Sequence
  Synthetic construct
gccagcauacagucuuauu

SEQ ID NO: 1765 - RNA, 19 nt, Artificial Sequence
  Synthetic construct
ccagcauacagucuuauua

SEQ ID NO: 1766 - RNA, 19 nt, Artificial Sequence
  Synthetic construct
agucuuacaccacucccaa

SEQ ID NO: 1767 - RNA, 19 nt, Artificial Sequence
  Synthetic construct
gucuuacaccacucccaag

SEQ ID NO: 1768 - RNA, 19 nt, Artificial Sequence
  Synthetic construct
caccacucccaagaagaau

SEQ ID NO: 1769 - RNA, 19 nt, Artificial Sequence
  Synthetic construct
accacucccaagaagaaua

SEQ ID NO: 1770 - RNA, 19 nt, Artificial Sequence
  Synthetic construct
ccacucccaagaagaauaa

SEQ ID NO: 1771 - RNA, 19 nt, Artificial Sequence
  Synthetic construct
ucccaagaagaauaagcac

SEQ ID NO: 1772 - RNA, 19 nt, Artificial Sequence
  Synthetic construct
cccaagaagaauaagcaca

SEQ ID NO: 1773 - RNA, 19 nt, Artificial Sequence
  Synthetic construct
ccaagaagaauaagcacaa

SEQ ID NO: 1774 - RNA, 19 nt, Artificial Sequence
  Synthetic construct
gcacaagagaaagaagguu

SEQ ID NO: 1775 - RNA, 19 nt, Artificial Sequence
  Synthetic construct
cacaagagaaagaagguua

SEQ ID NO: 1776 - RNA, 19 nt, Artificial Sequence
  Synthetic construct
gccucugcuucggaaucuu

SEQ ID NO: 1777 - RNA, 19 nt, Artificial Sequence
  Synthetic construct
ggaaucuuaugccuucauu

SEQ ID NO: 1778 - RNA, 19 nt, Artificial Sequence
  Synthetic construct
ccggcaugguccaacaauu

SEQ ID NO: 1779 - RNA, 19 nt, Artificial Sequence
  Synthetic construct
ggagauguaguuucaagaa

SEQ ID NO: 1780 - RNA, 19 nt, Artificial Sequence
  Synthetic construct
ccuagagaguaugguucuu

SEQ ID NO: 1781 - RNA, 19 nt, Artificial Sequence
  Synthetic construct
ccuucugguaccugcaaau

SEQ ID NO: 1782 - RNA, 19 nt, Artificial Sequence
  Synthetic construct
gguaccugcaaauccauau

SEQ ID NO: 1783 - RNA, 19 nt, Artificial Sequence
  Synthetic construct
ccauaucauacugcagaaa

SEQ ID NO: 1784 - RNA, 19 nt, Artificial Sequence
  Synthetic construct
ccugacuggcuucagguuu

SEQ ID NO: 1785 - RNA, 19 nt, Artificial Sequence
  Synthetic construct
gcagugguaugcccaacaa

SEQ ID NO: 1786 - RNA, 19 nt, Artificial Sequence
  Synthetic construct
gcuccuuccgggacaauaa

SEQ ID NO: 1787 - RNA, 19 nt, Artificial Sequence
  Synthetic construct
gggacaauaacggugugau

SEQ ID NO: 1788 - RNA, 19 nt, Artificial Sequence
  Synthetic construct
ggacaauaacggugugauu

SEQ ID NO: 1789 - RNA, 19 nt, Artificial Sequence
  Synthetic construct
ccucaggaaacgaccacuu

SEQ ID NO: 1790 - RNA, 19 nt, Artificial Sequence
  Synthetic construct
gccgugugccugaguuauu

SEQ ID NO: 1791 - RNA, 19 nt, Artificial Sequence
  Synthetic construct
ccgugugccugaguuauuu

SEQ ID NO: 1792 - RNA, 19 nt, Artificial Sequence
  Synthetic construct
gcacagaaucuugcuucau

SEQ ID NO: 1793 - RNA, 19 nt, Artificial Sequence
  Synthetic construct
ccuaacauccuucaagaau

SEQ ID NO: 1794 - RNA, 19 nt, Artificial Sequence
  Synthetic construct
gccagcauacagucuuauu

SEQ ID NO: 1795 - RNA, 19 nt, Artificial Sequence
  Synthetic construct
ccagcauacagucuuauua

SEQ ID NO: 1796 - RNA, 19 nt, Artificial Sequence
  Synthetic construct
uccacaacguuggaaauaa

SEQ ID NO: 1797 - RNA, 19 nt, Artificial Sequence
  Synthetic construct
ccacaacguuggaaauaaa

SEQ ID NO: 1798 - RNA, 19 nt, Artificial Sequence
  Synthetic construct
ggaaauaaagcugggccuc

SEQ ID NO: 1799 - RNA, 19 nt, Artificial Sequence
  Synthetic construct
gugucugcgccugcauauu

SEQ ID NO: 1800 - RNA, 19 nt, Artificial Sequence
  Synthetic construct
gcgccugcauauuccuaca

SEQ ID NO: 1801 - RNA, 19 nt, Artificial Sequence
  Synthetic construct
ccugcauauuccuacagcu

SEQ ID NO: 1802 - RNA, 19 nt, Artificial Sequence
  Synthetic construct
cugcauauuccuacagcuu

SEQ ID NO: 1803 - RNA, 19 nt, Artificial Sequence
  Synthetic construct
uccuacagcuucccagagu

SEQ ID NO: 1804 - RNA, 19 nt, Artificial Sequence
  Synthetic construct
ccagaguccugucgacaau

SEQ ID NO: 1805 - RNA, 19 nt, Artificial Sequence
  Synthetic construct
agaguccugucgacaauua

SEQ ID NO: 1806 - RNA, 19 nt, Artificial Sequence
  Synthetic construct
gguauggucugguauucuu

SEQ ID NO: 1807 - RNA, 19 nt, Artificial Sequence
  Synthetic construct
gcuagcguuuguaaagcua

SEQ ID NO: 1808 - RNA, 19 nt, Artificial Sequence
  Synthetic construct
gcagguauuagaugaucaa

SEQ ID NO: 1809 - RNA, 19 nt, Artificial Sequence
  Synthetic construct
gcagauggaaauggaaaua

SEQ ID NO: 1810 - RNA, 19 nt, Artificial Sequence
  Synthetic construct
ccaagugucacagucguaa

SEQ ID NO: 1811 - RNA, 19 nt, Artificial Sequence
  Synthetic construct
gcaguggacaaaucugcaa

SEQ ID NO: 1812 - RNA, 19 nt, Artificial Sequence
  Synthetic construct
gcugcuacagaaucuucua

SEQ ID NO: 1813 - RNA, 19 nt, Artificial Sequence
  Synthetic construct
gcgaaacacaaacaagaaa

SEQ ID NO: 1814 - RNA, 19 nt, Artificial Sequence
  Synthetic construct
ggaagugcauuaucaccuu

SEQ ID NO: 1815 - RNA, 19 nt, Artificial Sequence
  Synthetic construct
ccaagacaccagaugccaa

SEQ ID NO: 1816 - RNA, 19 nt, Artificial Sequence
  Synthetic construct
gggaugcccugguaaucaa

SEQ ID NO: 1817 - RNA, 19 nt, Artificial Sequence
  Synthetic construct
ggaggugauugagagggau

SEQ ID NO: 1818 - RNA, 19 nt, Artificial Sequence
  Synthetic construct
gguuagugguuccgagguu

SEQ ID NO: 1819 - RNA, 19 nt, Artificial Sequence
  Synthetic construct
ccaauguacucacgggauu

SEQ ID NO: 1820 - RNA, 19 nt, Artificial Sequence
  Synthetic construct
ggcuuugacuacuuacuaa

SEQ ID NO: 1821 - RNA, 19 nt, Artificial Sequence
  Synthetic construct
ggaugguuuccaguggcau

SEQ ID NO: 1822 - RNA, 19 nt, Artificial Sequence
  Synthetic construct
ccaguggcaugccagauuu

SEQ ID NO: 1823 - RNA, 19 nt, Artificial Sequence
  Synthetic construct
gcacauggccacucugaaa

SEQ ID NO: 1824 - RNA, 19 nt, Artificial Sequence
  Synthetic construct
gccaagaauauggagauua

SEQ ID NO: 1825 - RNA, 19 nt, Artificial Sequence
  Synthetic construct
gcucggauugaguaugcuu

SEQ ID NO: 1826 - RNA, 19 nt, Artificial Sequence
  Synthetic construct
gccucuggacaagaaugaa

SEQ ID NO: 1827 - RNA, 19 nt, Artificial Sequence
  Synthetic construct
gcagcucaugcggaugauu

SEQ ID NO: 1828 - RNA, 19 nt, Artificial Sequence
  Synthetic construct
gcucaugcggaugauuuau

SEQ ID NO: 1829 - RNA, 19 nt, Artificial Sequence
  Synthetic construct
gcggaugauuuauucccau

SEQ ID NO: 1830 - RNA, 19 nt, Artificial Sequence
  Synthetic construct
gcagcggaagauaauauuu

SEQ ID NO: 1831 - RNA, 19 nt, Artificial Sequence
  Synthetic construct
ggaaagacuuaucacgcaa

SEQ ID NO: 1832 - RNA, 19 nt, Artificial Sequence
  Synthetic construct
gcaauuggcaugggacuua

SEQ ID NO: 1833 - RNA, 19 nt, Artificial Sequence
  Synthetic construct
gcagcuggucuucauccaa

SEQ ID NO: 1834 - RNA, 19 nt, Artificial Sequence
  Synthetic construct
gcuaccgauuuauggauau

SEQ ID NO: 1835 - RNA, 19 nt, Artificial Sequence
  Synthetic construct
ccaaagcucuagggaguaa

SEQ ID NO: 1836 - RNA, 19 nt, Artificial Sequence
  Synthetic construct
ucaccacaccaacuucuaa

SEQ ID NO: 1837 - RNA, 19 nt, Artificial Sequence
  Synthetic construct
gccugccacuuucuagcau

SEQ ID NO: 1838 - RNA, 19 nt, Artificial Sequence
  Synthetic construct
gccacuuucuagcauccaa

SEQ ID NO: 1839 - RNA, 19 nt, Artificial Sequence
  Synthetic construct
ucuagcauccaacagaauu

SEQ ID NO: 1840 - RNA, 19 nt, Artificial Sequence
  Synthetic construct
ggcccaacucccaucuaau

SEQ ID NO: 1841 - RNA, 19 nt, Artificial Sequence
  Synthetic construct
gcacacuccuaauugacaa

SEQ ID NO: 1842 - RNA, 19 nt, Artificial Sequence
  Synthetic construct
ccagagaagcuacgcucau

SEQ ID NO: 1843 - RNA, 19 nt, Artificial Sequence
  Synthetic construct
ccagucacggauggagaaa

SEQ ID NO: 1844 - RNA, 19 nt, Artificial Sequence
  Synthetic construct
ggauggagaaauaugucau

SEQ ID NO: 1845 - RNA, 19 nt, Artificial Sequence
  Synthetic construct
ggaagccuuccuucugcuu

SEQ ID NO: 1846 - RNA, 19 nt, Artificial Sequence
  Synthetic construct
gcuugcaaacagccaucca

SEQ ID NO: 1847 - RNA, 19 nt, Artificial Sequence
  Synthetic construct
gcaaacagccauccaacaa

SEQ ID NO: 1848 - RNA, 19 nt, Artificial Sequence
  Synthetic construct
gggcuggaaacauaugguu

SEQ ID NO: 1849 - RNA, 19 nt, Artificial Sequence
  Synthetic construct
ggcuggaaacauaugguuu

SEQ ID NO: 1850 - RNA, 19 nt, Artificial Sequence
  Synthetic construct
gcuggaaacauaugguuug

SEQ ID NO: 1851 - RNA, 19 nt, Artificial Sequence
  Synthetic construct
gaagcacuccagcagcuau

SEQ ID NO: 1852 - RNA, 19 nt, Artificial Sequence
  Synthetic construct
gcacuccagcagcuauaau

SEQ ID NO: 1853 - RNA, 19 nt, Artificial Sequence
  Synthetic construct
gcuauaaucaaggugguua

SEQ ID NO: 1854 - RNA, 19 nt, Artificial Sequence
  Synthetic construct
gguuacaaccaagacagcu

SEQ ID NO: 1855 - RNA, 19 nt, Artificial Sequence
  Synthetic construct
gccaaccucagaugaguuu

SEQ ID NO: 1856 - RNA, 19 nt, Artificial Sequence
  Synthetic construct
gguuauaccgagaacuuaa

SEQ ID NO: 1857 - RNA, 19 nt, Artificial Sequence
  Synthetic construct
ccguguuaccuggaaccaa

SEQ ID NO: 1858 - RNA, 19 nt, Artificial Sequence
  Synthetic construct
gcaucgauggcuggaguaa

SEQ ID NO: 1859 - RNA, 19 nt, Artificial Sequence
  Synthetic construct
gcuaacgcgguccuguaaa

SEQ ID NO: 1860 - RNA, 19 nt, Artificial Sequence
  Synthetic construct
ccuguaaagaugaaaccuu

SEQ ID NO: 1861 - RNA, 19 nt, Artificial Sequence
  Synthetic construct
gcaacaaaggcuacagaau

SEQ ID NO: 1862 - RNA, 19 nt, Artificial Sequence
  Synthetic construct
gcagcaaagucucggucaa

SEQ ID NO: 1863 - RNA, 19 nt, Artificial Sequence
  Synthetic construct
ggagaugcagcaacaggaa

SEQ ID NO: 1864 - RNA, 19 nt, Artificial Sequence
  Synthetic construct
gcaacaggaacuggcacaa

SEQ ID NO: 1865 - RNA, 19 nt, Artificial Sequence
  Synthetic construct
gcucuacaaagcauuccuu

SEQ ID NO: 1866 - RNA, 19 nt, Artificial Sequence
  Synthetic construct
acuggcucaguagugccuu

SEQ ID NO: 1867 - RNA, 19 nt, Artificial Sequence
  Synthetic construct
cuggcucaguagugccuuu

SEQ ID NO: 1868 - RNA, 19 nt, Artificial Sequence
  Synthetic construct
uagcuacaucugguaccuu

SEQ ID NO: 1869 - RNA, 19 nt, Artificial Sequence
  Synthetic construct
gguaccuuggcuggcauua

SEQ ID NO: 1870 - RNA, 19 nt, Artificial Sequence
  Synthetic construct
guaccuuggcuggcauuau

SEQ ID NO: 1871 - RNA, 19 nt, Artificial Sequence
  Synthetic construct
uggcuggcauuaugggaau

SEQ ID NO: 1872 - RNA, 19 nt, Artificial Sequence
  Synthetic construct
ggcauuaugggaaugaggu

SEQ ID NO: 1873 - RNA, 19 nt, Artificial Sequence
  Synthetic construct
gcauuaugggaaugagguu

SEQ ID NO: 1874 - RNA, 19 nt, Artificial Sequence
  Synthetic construct
gggaaugagguucuaccac

SEQ ID NO: 1875 - RNA, 19 nt, Artificial Sequence
  Synthetic construct
ggaaugagguucuaccacu

SEQ ID NO: 1876 - RNA, 19 nt, Artificial Sequence
  Synthetic construct
ggcaauaguuugggaugaa

SEQ ID NO: 1877 - RNA, 19 nt, Artificial Sequence
  Synthetic construct
gcaauaguuugggaugaau

SEQ ID NO: 1878 - RNA, 19 nt, Artificial Sequence
  Synthetic construct
gcagcugaugugaagaaua

SEQ ID NO: 1879 - RNA, 19 nt, Artificial Sequence
  Synthetic construct
ggaggaguacagcuuagau

SEQ ID NO: 1880 - RNA, 19 nt, Artificial Sequence
  Synthetic construct
gcuuagaucucauuccauu

SEQ ID NO: 1881 - RNA, 19 nt, Artificial Sequence
  Synthetic construct
gcaagaaagcaaagaucau

SEQ ID NO: 1882 - RNA, 19 nt, Artificial Sequence
  Synthetic construct
ccguggaacaggaguuuau

SEQ ID NO: 1883 - RNA, 19 nt, Artificial Sequence
  Synthetic construct
ccuccaauccguguguaau

SEQ ID NO: 1884 - RNA, 19 nt, Artificial Sequence
  Synthetic construct
gcguaaccuucgcugaaau

SEQ ID NO: 1885 - RNA, 19 nt, Artificial Sequence
  Synthetic construct
ggaagauggagguacagaa

SEQ ID NO: 1886 - RNA, 19 nt, Artificial Sequence
  Synthetic construct
gaguguagccgcccaaauu

SEQ ID NO: 1887 - RNA, 19 nt, Artificial Sequence
  Synthetic construct
cccuaucugccgugacuuu

SEQ ID NO: 1888 - RNA, 19 nt, Artificial Sequence
  Synthetic construct
ggguagaggaguuaaagaa

SEQ ID NO: 1889 - RNA, 19 nt, Artificial Sequence
  Synthetic construct
ggccaccaaugagguacua

SEQ ID NO: 1890 - RNA, 19 nt, Artificial Sequence
  Synthetic construct
gcaaucaggccaaggucau

SEQ ID NO: 1891 - RNA, 19 nt, Artificial Sequence
  Synthetic construct
uccagugucccagcaagaa

SEQ ID NO: 1892 - RNA, 19 nt, Artificial Sequence
  Synthetic construct
cccuuggcaggaaucacaa

SEQ ID NO: 1893 - RNA, 19 nt, Artificial Sequence
  Synthetic construct
ccuuggcaggaaucacaau

SEQ ID NO: 1894 - RNA, 19 nt, Artificial Sequence
  Synthetic construct
ccacucccauggugacuua

SEQ ID NO: 1895 - RNA, 19 nt, Artificial Sequence
  Synthetic construct
ccauggugacuuacccuau

SEQ ID NO: 1896 - RNA, 21 nt, Artificial Sequence
  Synthetic construct
aacaacuucuccguagcagaa

SEQ ID NO: 1897 - RNA, 21 nt, Artificial Sequence
  Synthetic construct
aagguacuucgaugaugaauu

SEQ ID NO: 1898 - RNA, 21 nt, Artificial Sequence
  Synthetic construct
acgggcuaaagugaccaugaa

SEQ ID NO: 1899 - RNA, 21 nt, Artificial Sequence
  Synthetic construct
caagcguggugaauacaucaa

SEQ ID NO: 1900 - RNA, 21 nt, Artificial Sequence
  Synthetic construct
ccggaguguuagaauaugcca

SEQ ID NO: 1901 - RNA, 21 nt, Artificial Sequence
  Synthetic construct
acucgcugauccaaaugacaa

SEQ ID NO: 1902 - RNA, 21 nt, Artificial Sequence
  Synthetic construct
caggccuauggucgagauuua

SEQ ID NO: 1903 - RNA, 21 nt, Artificial Sequence
  Synthetic construct
uugaccgaagaaccaauuaua

SEQ ID NO: 1904 - RNA, 21 nt, Artificial Sequence
  Synthetic construct
cacaguaaucuucacacuuaa

SEQ ID NO: 1905 - RNA, 21 nt, Artificial Sequence
  Synthetic construct
ucggauaaaguccuuauucaa

SEQ ID NO: 1906 - RNA, 21 nt, Artificial Sequence
  Synthetic construct
cgggacguccuuaaggaugua

SEQ ID NO: 1907 - RNA, 21 nt, Artificial Sequence
  Synthetic construct
agccagauugucagcccucua

SEQ ID NO: 1908 - RNA, 21 nt, Artificial Sequence
  Synthetic construct
gaggauggaaacacccuucua

SEQ ID NO: 1909 - RNA, 21 nt, Artificial Sequence
  Synthetic construct
cggcagcaugaugaagaagga

SEQ ID NO: 1910 - RNA, 21 nt, Artificial Sequence
  Synthetic construct
cccgccguugucgcccaucga

SEQ ID NO: 1911 - RNA, 21 nt, Artificial Sequence
  Synthetic construct
cgcggccggcagcaugaugaa

SEQ ID NO: 1912 - RNA, 21 nt, Artificial Sequence
  Synthetic construct
guggauguugaugguaguaca

SEQ ID NO: 1913 - RNA, 21 nt, Artificial Sequence
  Synthetic construct
aagacguuccugaagcuugcc

SEQ ID NO: 1914 - RNA, 21 nt, Artificial Sequence
  Synthetic construct
cagaucuuaguaagcuauaua

SEQ ID NO: 1915 - RNA, 21 nt, Artificial Sequence
  Synthetic construct
ugggaaauagaagccagugaa

SEQ ID NO: 1916 - RNA, 21 nt, Artificial Sequence
  Synthetic construct
aaaggccagcaccugaagaau

SEQ ID NO: 1917 - RNA, 21 nt, Artificial Sequence
  Synthetic construct
aagacguauguuggaacaaau

SEQ ID NO: 1918 - RNA, 21 nt, Artificial Sequence
  Synthetic construct
caagacguauguuggaacaaa

SEQ ID NO: 1919 - RNA, 21 nt, Artificial Sequence
  Synthetic construct
aaggcaaugcugucauauuau

SEQ ID NO: 1920 - RNA, 21 nt, Artificial Sequence
  Synthetic construct
gagguuaaagacagucauaua

SEQ ID NO: 1921 - RNA, 21 nt, Artificial Sequence
  Synthetic construct
cuccuaguacuuagaaauaca

SEQ ID NO: 1922 - RNA, 21 nt, Artificial Sequence
  Synthetic construct
uuggcuauacugcaucacuua

SEQ ID NO: 1923 - RNA, 21 nt, Artificial Sequence
  Synthetic construct
cuggacgauccucucagugca

SEQ ID NO: 1924 - RNA, 21 nt, Artificial Sequence
  Synthetic construct
caagccaggaauguucgguua

SEQ ID NO: 1925 - RNA, 21 nt, Artificial Sequence
  Synthetic construct
cccaguagcccuauuccaaga

SEQ ID NO: 1926 - RNA, 21 nt, Artificial Sequence
  Synthetic construct
aagcggguaguagaucaugca

SEQ ID NO: 1927 - RNA, 21 nt, Artificial Sequence
  Synthetic construct
caaccuauaauggguggguaa

SEQ ID NO: 1928 - RNA, 21 nt, Artificial Sequence
  Synthetic construct
gaaguuauucauauacgucua

SEQ ID NO: 1929 - RNA, 21 nt, Artificial Sequence
  Synthetic construct
acccauaagguuuaggauaga

SEQ ID NO: 1930 - RNA, 21 nt, Artificial Sequence
  Synthetic construct
cucaggagaagcagagcacaa

SEQ ID NO: 1931 - RNA, 21 nt, Artificial Sequence
  Synthetic construct
aagacgcuuggcccagcucaa

SEQ ID NO: 1932 - RNA, 21 nt, Artificial Sequence
  Synthetic construct
agggaugaggugacgggugaa

SEQ ID NO: 1933 - RNA, 21 nt, Artificial Sequence
  Synthetic construct
cucgagguugcaggacucuuu

SEQ ID NO: 1934 - RNA, 21 nt, Artificial Sequence
  Synthetic construct
cagcaaccaauuaucaguuua

SEQ ID NO: 1935 - RNA, 21 nt, Artificial Sequence
  Synthetic construct
uaggguuagaggcgagauuaa

SEQ ID NO: 1936 - RNA, 21 nt, Artificial Sequence
  Synthetic construct
cgccgccgucccagauauuaa

SEQ ID NO: 1937 - RNA, 21 nt, Artificial Sequence
  Synthetic construct
aaagaauauaugcuaggguua

SEQ ID NO: 1938 - RNA, 21 nt, Artificial Sequence
  Synthetic construct
uacaggauguugucccaucaa

SEQ ID NO: 1939 - RNA, 21 nt, Artificial Sequence
  Synthetic construct
cacauggaucucaaugccaau

SEQ ID NO: 1940 - RNA, 21 nt, Artificial Sequence
  Synthetic construct
uuccaagauccgcgucugaaa

SEQ ID NO: 1941 - RNA, 21 nt, Artificial Sequence
  Synthetic construct
ugggagaauccaaauaguauu

SEQ ID NO: 1942 - RNA, 21 nt, Artificial Sequence
  Synthetic construct
cagccuuaucuuagagguaca

SEQ ID NO: 1943 - RNA, 21 nt, Artificial Sequence
  Synthetic construct
uacauccaaaccaguacgcaa

SEQ ID NO: 1944 - RNA, 21 nt, Artificial Sequence
  Synthetic construct
ucagugcaaguuacaucuaua

SEQ ID NO: 1945 - RNA, 21 nt, Artificial Sequence
  Synthetic construct
uacuacaaggcuggaacucaa

SEQ ID NO: 1946 - RNA, 21 nt, Artificial Sequence
  Synthetic construct
ccgccucauguuugaauacca

SEQ ID NO: 1947 - RNA, 21 nt, Artificial Sequence
  Synthetic construct
aaggugcaguacgugauucaa

SEQ ID NO: 1948 - RNA, 21 nt, Artificial Sequence
  Synthetic construct
uagcgugguccggaauggaaa

SEQ ID NO: 1949 - RNA, 21 nt, Artificial Sequence
  Synthetic construct
ugcccguagauuucagcaaua

SEQ ID NO: 1950 - RNA, 21 nt, Artificial Sequence
  Synthetic construct
caggagcgucuuucucaggaa

SEQ ID NO: 1951 - RNA, 21 nt, Artificial Sequence
  Synthetic construct
aaggaagcacauguugcuaaa

SEQ ID NO: 1952 - RNA, 21 nt, Artificial Sequence
  Synthetic construct
gagcgaagaagcaauacugaa

SEQ ID NO: 1953 - RNA, 21 nt, Artificial Sequence
  Synthetic construct
uacaggcucaagauuagauua

SEQ ID NO: 1954 - RNA, 21 nt, Artificial Sequence
  Synthetic construct
cagcauaaacaguaucucgga

SEQ ID NO: 1955 - RNA, 21 nt, Artificial Sequence
  Synthetic construct
cggcgugcagguggugauuga

SEQ ID NO: 1956 - RNA, 21 nt, Artificial Sequence
  Synthetic construct
cgccuguaagagugagacuaa

SEQ ID NO: 1957 - RNA, 21 nt, Artificial Sequence
  Synthetic construct
uuggagcggcccagcagugua

SEQ ID NO: 1958 - RNA, 21 nt, Artificial Sequence
  Synthetic construct
cuggcuggauugaggaguaga

SEQ ID NO: 1959 - RNA, 21 nt, Artificial Sequence
  Synthetic construct
cuggaugacaguugggugaua

SEQ ID NO: 1960 - RNA, 21 nt, Artificial Sequence
  Synthetic construct
aaagacggaaggcauacuaaa

SEQ ID NO: 1961 - RNA, 21 nt, Artificial Sequence
  Synthetic construct
uacgaauucuaucuuugggaa

SEQ ID NO: 1962 - RNA, 21 nt, Artificial Sequence
  Synthetic construct
aacgguuagauuuaguuacca

SEQ ID NO: 1963 - RNA, 21 nt, Artificial Sequence
  Synthetic construct
aaacggcgagauguagcugaa

SEQ ID NO: 1964 - RNA, 21 nt, Artificial Sequence
  Synthetic construct
uccucgaagauucaaucucaa

SEQ ID NO: 1965 - RNA, 21 nt, Artificial Sequence
  Synthetic construct
augaccuguugcagcuauuaa

SEQ ID NO: 1966 - RNA, 21 nt, Artificial Sequence
  Synthetic construct
ccagcucaagagguuuggaua

SEQ ID NO: 1967 - RNA, 21 nt, Artificial Sequence
  Synthetic construct
cagacccuuuggaccgacaaa

SEQ ID NO: 1968 - RNA, 21 nt, Artificial Sequence
  Synthetic construct
cucguggacugguuaguugaa

SEQ ID NO: 1969 - RNA, 21 nt, Artificial Sequence
  Synthetic construct
accagagacacuaaaucugua

SEQ ID NO: 1970 - RNA, 21 nt, Artificial Sequence
  Synthetic construct
gccagcugucaggauaauaaa

SEQ ID NO: 1971 - RNA, 21 nt, Artificial Sequence
  Synthetic construct
aaagcuggccugaaucauuaa

SEQ ID NO: 1972 - RNA, 21 nt, Artificial Sequence
  Synthetic construct
cugcagcugaaucacacagga

SEQ ID NO: 1973 - RNA, 21 nt, Artificial Sequence
  Synthetic construct
uacggaugagcauuuagugaa

SEQ ID NO: 1974 - RNA, 21 nt, Artificial Sequence
  Synthetic construct
aagcauggagauuucuucuau

SEQ ID NO: 1975 - RNA, 21 nt, Artificial Sequence
  Synthetic construct
cuggaaagaucagaauauuau

SEQ ID NO: 1976 - RNA, 21 nt, Artificial Sequence
  Synthetic construct
uuggauaugauacaaaucuuu

SEQ ID NO: 1977 - RNA, 21 nt, Artificial Sequence
  Synthetic construct
ccgggcgaggauuaguauuau

SEQ ID NO: 1978 - RNA, 21 nt, Artificial Sequence
  Synthetic construct
uucacauaccaggguuauuaa

SEQ ID NO: 1979 - RNA, 21 nt, Artificial Sequence
  Synthetic construct
cuguuguagauagccagucaa

SEQ ID NO: 1980 - RNA, 21 nt, Artificial Sequence
  Synthetic construct
cagggaaguuagucaaaugaa

SEQ ID NO: 1981 - RNA, 21 nt, Artificial Sequence
  Synthetic construct
cacgaacaugcaguuauugaa

SEQ ID NO: 1982 - RNA, 21 nt, Artificial Sequence
  Synthetic construct
cuggauauguacuaacgaaua

SEQ ID NO: 1983 - RNA, 21 nt, Artificial Sequence
  Synthetic construct
uagcaguacaaugauuaguaa

SEQ ID NO: 1984 - RNA, 21 nt, Artificial Sequence
  Synthetic construct
cccgggaugaacggauugaaa

SEQ ID NO: 1985 - RNA, 21 nt, Artificial Sequence
  Synthetic construct
auggaacacggccacaucaaa

SEQ ID NO: 1986 - RNA, 21 nt, Artificial Sequence
  Synthetic construct
cgcagccgugcccaucgucaa

SEQ ID NO: 1987 - RNA, 21 nt, Artificial Sequence
  Synthetic construct
cagggacuccuguuuacgaca

SEQ ID NO: 1988 - RNA, 21 nt, Artificial Sequence
  Synthetic construct
cagccagugucuaaacuccaa

SEQ ID NO: 1989 - RNA, 21 nt, Artificial Sequence
  Synthetic construct
aacaacggaauguaucaauga

SEQ ID NO: 1990 - RNA, 21 nt, Artificial Sequence
  Synthetic construct
uuagucuacguuggagguaaa

SEQ ID NO: 1991 - RNA, 21 nt, Artificial Sequence
  Synthetic construct
auggauacacgugcauuuaaa

SEQ ID NO: 1992 - RNA, 21 nt, Artificial Sequence
  Synthetic construct
auggauccaacugauuagcaa

SEQ ID NO: 1993 - RNA, 21 nt, Artificial Sequence
  Synthetic construct
auggucccugucagcaaagaa

SEQ ID NO: 1994 - RNA, 21 nt, Artificial Sequence
  Synthetic construct
aagaagcaaccaagucuacaa

SEQ ID NO: 1995 - RNA, 21 nt, Artificial Sequence
  Synthetic construct
aacucuggcuugcuaacuuaa

SEQ ID NO: 1996 - RNA, 21 nt, Artificial Sequence
  Synthetic construct
augaacaauauugaacgcuau

SEQ ID NO: 1997 - RNA, 21 nt, Artificial Sequence
  Synthetic construct
gucgauagugauauucaguca

SEQ ID NO: 1998 - RNA, 21 nt, Artificial Sequence
  Synthetic construct
caggcaucugauguuauagau

SEQ ID NO: 1999 - RNA, 21 nt, Artificial Sequence
  Synthetic construct
uccguugucuagauuugagua

SEQ ID NO: 2000 - RNA, 21 nt, Artificial Sequence
  Synthetic construct
gaccagacauauccuagcuaa

SEQ ID NO: 2001 - RNA, 21 nt, Artificial Sequence
  Synthetic construct
aagcaauaccgucauguuuca

SEQ ID NO: 2002 - RNA, 21 nt, Artificial Sequence
  Synthetic construct
agcuguagagcuugcaacuua

SEQ ID NO: 2003 - RNA, 21 nt, Artificial Sequence
  Synthetic construct
cugcaugaugacagaagccga

SEQ ID NO: 2004 - RNA, 21 nt, Artificial Sequence
  Synthetic construct
ccgacaguccaaggagcugua

SEQ ID NO: 2005 - RNA, 21 nt, Artificial Sequence
  Synthetic construct
cgccguguaccacauggugua

SEQ ID NO: 2006 - RNA, 21 nt, Artificial Sequence
  Synthetic construct
cagcacguccguguucaagca

SEQ ID NO: 2007 - RNA, 21 nt, Artificial Sequence
  Synthetic construct
aucgaguaaggcacacccaaa

SEQ ID NO: 2008 - RNA, 21 nt, Artificial Sequence
  Synthetic construct
cucccguugcgucaagucuaa

SEQ ID NO: 2009 - RNA, 21 nt, Artificial Sequence
  Synthetic construct
acccuuuagugcuuugugaua

SEQ ID NO: 2010 - RNA, 21 nt, Artificial Sequence
  Synthetic construct
aagguaaugaccaguuguuau

SEQ ID NO: 2011 - RNA, 21 nt, Artificial Sequence
  Synthetic construct
ucccgccuuucuauuccacaa

SEQ ID NO: 2012 - RNA, 21 nt, Artificial Sequence
  Synthetic construct
caccgcccuuaauccauuuaa

SEQ ID NO: 2013 - RNA, 21 nt, Artificial Sequence
  Synthetic construct
uucaagcaucuguuuaacaaa

SEQ ID NO: 2014 - RNA, 21 nt, Artificial Sequence
  Synthetic construct
auggaaacuaccuuaaacgaa

SEQ ID NO: 2015 - RNA, 21 nt, Artificial Sequence
  Synthetic construct
augcguaggcuuaugucuaaa

SEQ ID NO: 2016 - RNA, 21 nt, Artificial Sequence
  Synthetic construct
acacgggauguuauuauuauu

SEQ ID NO: 2017 - RNA, 21 nt, Artificial Sequence
  Synthetic construct
cuagcggagaucgaugccaua

SEQ ID NO: 2018 - RNA, 21 nt, Artificial Sequence
  Synthetic construct
cuguccaugucuuacuacuuu

SEQ ID NO: 2019 - RNA, 21 nt, Artificial Sequence
  Synthetic construct
uugggaugaaucagaaaucua

SEQ ID NO: 2020 - RNA, 21 nt, Artificial Sequence
  Synthetic construct
aagugccguuguucaguucua

SEQ ID NO: 2021 - RNA, 21 nt, Artificial Sequence
  Synthetic construct
cucauuaguuugggcaguaua

SEQ ID NO: 2022 - RNA, 21 nt, Artificial Sequence
  Synthetic construct
ucgggucggcccauucgcaaa

SEQ ID NO: 2023 - RNA, 21 nt, Artificial Sequence
  Synthetic construct
uaccguuaugggcgagaggaa

SEQ ID NO: 2024 - RNA, 21 nt, Artificial Sequence
  Synthetic construct
cccuaugauguccacgauuau

SEQ ID NO: 2025 - RNA, 21 nt, Artificial Sequence
  Synthetic construct
cggcgcaaguuugaauuugau

SEQ ID NO: 2026 - RNA, 21 nt, Artificial Sequence
  Synthetic construct
uugcggcaagaacacuauuua

SEQ ID NO: 2027 - RNA, 21 nt, Artificial Sequence
  Synthetic construct
uucaguuuauuuggauuauua

SEQ ID NO: 2028 - RNA, 21 nt, Artificial Sequence
  Synthetic construct
cagcuauucuucagcuuggua

SEQ ID NO: 2029 - RNA, 21 nt, Artificial Sequence
  Synthetic construct
cagccgaagacugaucgacau

SEQ ID NO: 2030 - RNA, 21 nt, Artificial Sequence
  Synthetic construct
gagggaauuauuggauccuaa

SEQ ID NO: 2031 - RNA, 21 nt, Artificial Sequence
  Synthetic construct
uagaaauacuacauaggguaa

SEQ ID NO: 2032 - RNA, 21 nt, Artificial Sequence
  Synthetic construct
cagguugcuugugguuacuau

SEQ ID NO: 2033 - RNA, 21 nt, Artificial Sequence
  Synthetic construct
uaggacagcuaggucaugaaa

SEQ ID NO: 2034 - RNA, 21 nt, Artificial Sequence
  Synthetic construct
cacacuaagggcaagaucgaa

SEQ ID NO: 2035 - RNA, 21 nt, Artificial Sequence
  Synthetic construct
cgggcuuaugccaaagaugua

SEQ ID NO: 2036 - RNA, 21 nt, Artificial Sequence
  Synthetic construct
aaggcuucgagaagauuagca

SEQ ID NO: 2037 - RNA, 21 nt, Artificial Sequence
  Synthetic construct
caccaccagaugagaaguuaa

SEQ ID NO: 2038 - RNA, 21 nt, Artificial Sequence
  Synthetic construct
caggguuuggugacaauagaa

SEQ ID NO: 2039 - RNA, 21 nt, Artificial Sequence
  Synthetic construct
acaguacgagaaaucauugaa

SEQ ID NO: 2040 - RNA, 21 nt, Artificial Sequence
  Synthetic construct
cuggcggcauuugauuguauu

SEQ ID NO: 2041 - RNA, 21 nt, Artificial Sequence
  Synthetic construct
aacucgugugauccaguguua

SEQ ID NO: 2042 - RNA, 21 nt, Artificial Sequence
  Synthetic construct
agguccuauuguacuuacuaa

SEQ ID NO: 2043 - RNA, 21 nt, Artificial Sequence
  Synthetic construct
cccagugaguuuggacgcaaa

SEQ ID NO: 2044 - RNA, 21 nt, Artificial Sequence
  Synthetic construct
uccaaggagcaucuuccgcaa

SEQ ID NO: 2045 - RNA, 21 nt, Artificial Sequence
  Synthetic construct
auggcagcgaagauaguucaa

SEQ ID NO: 2046 - RNA, 21 nt, Artificial Sequence
  Synthetic construct
cagagcugaccuguccgguaa

SEQ ID NO: 2047 - RNA, 21 nt, Artificial Sequence
  Synthetic construct
caggguaucccauccguguaa

SEQ ID NO: 2048 - RNA, 21 nt, Artificial Sequence
  Synthetic construct
ccacgggaauguaacagguaa

SEQ ID NO: 2049 - RNA, 21 nt, Artificial Sequence
  Synthetic construct
auagcggaccuguacacuuaa

SEQ ID NO: 2050 - RNA, 21 nt, Artificial Sequence
  Synthetic construct
cacaaucgcuuugguuaugaa

SEQ ID NO: 2051 - RNA, 21 nt, Artificial Sequence
  Synthetic construct
cacaaugguaaggcacauaaa

SEQ ID NO: 2052 - RNA, 21 nt, Artificial Sequence
  Synthetic construct
ugccguaggauuuacagaaua

SEQ ID NO: 2053 - RNA, 21 nt, Artificial Sequence
  Synthetic construct
aaaggaaucaucuguagcgaa

SEQ ID NO: 2054 - RNA, 21 nt, Artificial Sequence
  Synthetic construct
cagcaggguuagcauaaagga

SEQ ID NO: 2055 - RNA, 21 nt, Artificial Sequence
  Synthetic construct
cgggacuuucuauuaauauca

SEQ ID NO: 2056 - RNA, 21 nt, Artificial Sequence
  Synthetic construct
aucuuuauaaucagacuggaa

SEQ ID NO: 2057 - RNA, 21 nt, Artificial Sequence
  Synthetic construct
uaacuucaaauuccagccaaa

SEQ ID NO: 2058 - RNA, 21 nt, Artificial Sequence
  Synthetic construct
auaggauaauuuaaccuacca

SEQ ID NO: 2059 - RNA, 21 nt, Artificial Sequence
  Synthetic construct
auggauuguggucucaguuua

SEQ ID NO: 2060 - RNA, 21 nt, Artificial Sequence
  Synthetic construct
cacgagugugaacuagaauua

SEQ ID NO: 2061 - RNA, 21 nt, Artificial Sequence
  Synthetic construct
caggucacugacauugucgua

SEQ ID NO: 2062 - RNA, 21 nt, Artificial Sequence
  Synthetic construct
cucaguauaggcuucuaguaa

SEQ ID NO: 2063 - RNA, 21 nt, Artificial Sequence
  Synthetic construct
ucggagcacaagcgcaagaaa

SEQ ID NO: 2064 - RNA, 21 nt, Artificial Sequence
  Synthetic construct
aaccgggacgaagccaucaaa

SEQ ID NO: 2065 - RNA, 21 nt, Artificial Sequence
  Synthetic construct
uccacugagcaucacaauaaa

SEQ ID NO: 2066 - RNA, 21 nt, Artificial Sequence
  Synthetic construct
caggagcagcuccaggcagaa

SEQ ID NO: 2067 - RNA, 21 nt, Artificial Sequence
  Synthetic construct
aagaaggcacggaaggcuaug

SEQ ID NO: 2068 - RNA, 21 nt, Artificial Sequence
  Synthetic construct
cugcuucacaggauccagaaa

SEQ ID NO: 2069 - RNA, 21 nt, Artificial Sequence
  Synthetic construct
aucgaagauuuaucccagcaa

SEQ ID NO: 2070 - RNA, 21 nt, Artificial Sequence
  Synthetic construct
ugcgguugguguccuggcaaa

SEQ ID NO: 2071 - RNA, 21 nt, Artificial Sequence
  Synthetic construct
cagacuguagagccacauuua

SEQ ID NO: 2072 - RNA, 21 nt, Artificial Sequence
  Synthetic construct
auggcagacauugacaacaaa

SEQ ID NO: 2073 - RNA, 21 nt, Artificial Sequence
  Synthetic construct
caccacgcuuugauaacuaaa

SEQ ID NO: 2074 - RNA, 21 nt, Artificial Sequence
  Synthetic construct
ucgccgauauuuggaguucuu

SEQ ID NO: 2075 - RNA, 21 nt, Artificial Sequence
  Synthetic construct
aggcaauucaguggacuauaa

SEQ ID NO: 2076 - RNA, 21 nt, Artificial Sequence
  Synthetic construct
cccggugguuuccuagaaaca

SEQ ID NO: 2077 - RNA, 21 nt, Artificial Sequence
  Synthetic construct
accgcaguauuguccaaauua

SEQ ID NO: 2078 - RNA, 21 nt, Artificial Sequence
  Synthetic construct
agggcccaacaugaaggugua

SEQ ID NO: 2079 - RNA, 21 nt, Artificial Sequence
  Synthetic construct
cagggcgucuuccuaaguuau

SEQ ID NO: 2080 - RNA, 21 nt, Artificial Sequence
  Synthetic construct
cccgcccguuugggaggagaa

SEQ ID NO: 2081 - RNA, 21 nt, Artificial Sequence
  Synthetic construct
aucgggcucgauggaggaaga

SEQ ID NO: 2082 - RNA, 21 nt, Artificial Sequence
  Synthetic construct
cggcguguucagcgucacuga

SEQ ID NO: 2083 - RNA, 21 nt, Artificial Sequence
  Synthetic construct
caacauaacacuaauuauaaa

SEQ ID NO: 2084 - RNA, 21 nt, Artificial Sequence
  Synthetic construct
cccgaaauagcacaaaugaaa

SEQ ID NO: 2085 - RNA, 21 nt, Artificial Sequence
  Synthetic construct
aagacgggaaugaugagguaa

SEQ ID NO: 2086 - RNA, 21 nt, Artificial Sequence
  Synthetic construct
cccggugguucagucaaacca

SEQ ID NO: 2087 - RNA, 21 nt, Artificial Sequence
  Synthetic construct
uuggcuguagccacacggaua

SEQ ID NO: 2088 - RNA, 21 nt, Artificial Sequence
  Synthetic construct
uacauuggaucggcaacuaaa

SEQ ID NO: 2089 - RNA, 21 nt, Artificial Sequence
  Synthetic construct
caggacguuccaguucaaauu

SEQ ID NO: 2090 - RNA, 21 nt, Artificial Sequence
  Synthetic construct
aagccuguaucaacucuggua

SEQ ID NO: 2091 - RNA, 21 nt, Artificial Sequence
  Synthetic construct
auggcuauaauauggcuauaa

SEQ ID NO: 2092 - RNA, 21 nt, Artificial Sequence
  Synthetic construct
caggacaagcacgacgaucuu

SEQ ID NO: 2093 - RNA, 21 nt, Artificial Sequence
  Synthetic construct
uaagcuaguuauaaucaugua

SEQ ID NO: 2094 - RNA, 21 nt, Artificial Sequence
  Synthetic construct
cugcaacaaguauguugauua

SEQ ID NO: 2095 - RNA, 21 nt, Artificial Sequence
  Synthetic construct
aaggguggucucauaagauua

SEQ ID NO: 2096 - RNA, 21 nt, Artificial Sequence
  Synthetic construct
accggcagauacacuuaauga

SEQ ID NO: 2097 - RNA, 21 nt, Artificial Sequence
  Synthetic construct
cagucguaaaucaaagaguaa

SEQ ID NO: 2098 - RNA, 21 nt, Artificial Sequence
  Synthetic construct
cacccauuuaugacugccgua

SEQ ID NO: 2099 - RNA, 21 nt, Artificial Sequence
  Synthetic construct
cagacucuagaucucguuaga

SEQ ID NO: 2100 - RNA, 21 nt, Artificial Sequence
  Synthetic construct
aggucgguaauuuaacauaaa

SEQ ID NO: 2101 - RNA, 21 nt, Artificial Sequence
  Synthetic construct
cacucgaauguuagcagauuu

SEQ ID NO: 2102 - RNA, 21 nt, Artificial Sequence
  Synthetic construct
augguaagccuuagcagcaaa

SEQ ID NO: 2103 - RNA, 21 nt, Artificial Sequence
  Synthetic construct
aagauccaccuccgacccuua

SEQ ID NO: 2104 - RNA, 21 nt, Artificial Sequence
  Synthetic construct
auggcggagcccagucccgaa

SEQ ID NO: 2105 - RNA, 21 nt, Artificial Sequence
  Synthetic construct
cagugcuaccuugcuugagaa

SEQ ID NO: 2106 - RNA, 21 nt, Artificial Sequence
  Synthetic construct
cucccgguacaugagaaucaa

SEQ ID NO: 2107 - RNA, 21 nt, Artificial Sequence
  Synthetic construct
caggucccuauuaucauaaau

SEQ ID NO: 2108 - RNA, 21 nt, Artificial Sequence
  Synthetic construct
uucgugcucaacagcaaagaa

SEQ ID NO: 2109 - RNA, 21 nt, Artificial Sequence
  Synthetic construct
cucagaagggaaguuaccuaa

SEQ ID NO: 2110 - RNA, 21 nt, Artificial Sequence
  Synthetic construct
cuguaacuauugccauauaaa

SEQ ID NO: 2111 - RNA, 21 nt, Artificial Sequence
  Synthetic construct
ccgcaacaacucagccaucca

SEQ ID NO: 2112 - RNA, 21 nt, Artificial Sequence
  Synthetic construct
auccaguggaauacacccuua

SEQ ID NO: 2113 - RNA, 21 nt, Artificial Sequence
  Synthetic construct
acccaaugacauuuaugucaa

SEQ ID NO: 2114 - RNA, 21 nt, Artificial Sequence
  Synthetic construct
cucgguuugauuugauacuaa

SEQ ID NO: 2115 - RNA, 21 nt, Artificial Sequence
  Synthetic construct
aggacuauucuugauaagaaa

SEQ ID NO: 2116 - RNA, 21 nt, Artificial Sequence
  Synthetic construct
cuggauaggacuauucuugau

SEQ ID NO: 2117 - RNA, 21 nt, Artificial Sequence
  Synthetic construct
cagccuaauugagcccuauua

SEQ ID NO: 2118 - RNA, 21 nt, Artificial Sequence
  Synthetic construct
cagcagcaaucucuucccgaa

SEQ ID NO: 2119 - RNA, 21 nt, Artificial Sequence
  Synthetic construct
agagaaccuauugauaauuua

SEQ ID NO: 2120 - RNA, 21 nt, Artificial Sequence
  Synthetic construct
ccugaagauguuuaaacguga

SEQ ID NO: 2121 - RNA, 21 nt, Artificial Sequence
  Synthetic construct
uaccguaacaauguuugucau

SEQ ID NO: 2122 - RNA, 21 nt, Artificial Sequence
  Synthetic construct
aaggacaucaccuuucaguau

SEQ ID NO: 2123 - RNA, 21 nt, Artificial Sequence
  Synthetic construct
aagcaugucaaguggauagua

SEQ ID NO: 2124 - RNA, 21 nt, Artificial Sequence
  Synthetic construct
gugggagacuaagauguauua

SEQ ID NO: 2125 - RNA, 21 nt, Artificial Sequence
  Synthetic construct
uacagucuuauuagucaagga

SEQ ID NO: 2126 - RNA, 21 nt, Artificial Sequence
  Synthetic construct
ccagaaccuaacauccuucaa

SEQ ID NO: 2127 - RNA, 21 nt, Artificial Sequence
  Synthetic construct
aacgauccuccacuugaccaa

SEQ ID NO: 2128 - RNA, 21 nt, Artificial Sequence
  Synthetic construct
cgggacaauaacggugugauu

SEQ ID NO: 2129 - RNA, 21 nt, Artificial Sequence
  Synthetic construct
cuagaggucuuugcaagggaa

SEQ ID NO: 2130 - RNA, 21 nt, Artificial Sequence
  Synthetic construct
uacacugaugacggccuagaa

SEQ ID NO: 2131 - RNA, 21 nt, Artificial Sequence
  Synthetic construct
aaacuggaguuuaucaaggaa

SEQ ID NO: 2132 - RNA, 21 nt, Artificial Sequence
  Synthetic construct
caggaaccggcaagaccacaa

SEQ ID NO: 2133 - RNA, 21 nt, Artificial Sequence
  Synthetic construct
uucgaaucaucugauauuuau

SEQ ID NO: 2134 - RNA, 21 nt, Artificial Sequence
  Synthetic construct
aaggguuuagauguagauucu

SEQ ID NO: 2135 - RNA, 21 nt, Artificial Sequence
  Synthetic construct
aaguacguauugacagaauua

SEQ ID NO: 2136 - RNA, 21 nt, Artificial Sequence
  Synthetic construct
acgaaucucgcgagaagucaa

SEQ ID NO: 2137 - RNA, 21 nt, Artificial Sequence
  Synthetic construct
gccgaguguaacaaccauaua

SEQ ID NO: 2138 - RNA, 21 nt, Artificial Sequence
  Synthetic construct
cucaauggaucuagaacuuca

SEQ ID NO: 2139 - RNA, 21 nt, Artificial Sequence
  Synthetic construct
gagacccaccuugcucauaaa

SEQ ID NO: 2140 - RNA, 21 nt, Artificial Sequence
  Synthetic construct
cuggacuauuucuguguuuau

SEQ ID NO: 2141 - RNA, 21 nt, Artificial Sequence
  Synthetic construct
cugacuuacuguuucaacaaa

SEQ ID NO: 2142 - RNA, 21 nt, Artificial Sequence
  Synthetic construct
cugcgguggagccgccaccaa

SEQ ID NO: 2143 - RNA, 21 nt, Artificial Sequence
  Synthetic construct
gacaaguaacuguaugaguua

SEQ ID NO: 2144 - RNA, 21 nt, Artificial Sequence
  Synthetic construct
ucgagguugaacccucggaua

SEQ ID NO: 2145 - RNA, 21 nt, Artificial Sequence
  Synthetic construct
aaccaugguucugaagauuua

SEQ ID NO: 2146 - RNA, 21 nt, Artificial Sequence
  Synthetic construct
aacgaguugagucauccgaau

SEQ ID NO: 2147 - RNA, 21 nt, Artificial Sequence
  Synthetic construct
auuggugauacuucuaaacua

SEQ ID NO: 2148 - RNA, 21 nt, Artificial Sequence
  Synthetic construct
cagacuggguuaagcuaccaa

SEQ ID NO: 2149 - RNA, 21 nt, Artificial Sequence
  Synthetic construct
aauccugagccuacucgaauc

SEQ ID NO: 2150 - RNA, 21 nt, Artificial Sequence
  Synthetic construct
cagauccugagccuacucgaa

SEQ ID NO: 2151 - RNA, 21 nt, Artificial Sequence
  Synthetic construct
cagccugacauggacccacua

SEQ ID NO: 2152 - RNA, 21 nt, Artificial Sequence
  Synthetic construct
cagucucuugcaaucggcuaa

SEQ ID NO: 2153 - RNA, 21 nt, Artificial Sequence
  Synthetic construct
cagcguuacaguaauguucca

SEQ ID NO: 2154 - RNA, 21 nt, Artificial Sequence
  Synthetic construct
gagagguacuacuaaccaaua

SEQ ID NO: 2155 - RNA, 21 nt, Artificial Sequence
  Synthetic construct
aaggccauagcuuuaagagau

SEQ ID NO: 2156 - RNA, 21 nt, Artificial Sequence
  Synthetic construct
acagagcagcuuguugcuaua

SEQ ID NO: 2157 - RNA, 21 nt, Artificial Sequence
  Synthetic construct
aaggauuccaaguaacucuua

SEQ ID NO: 2158 - RNA, 21 nt, Artificial Sequence
  Synthetic construct
aucagagaucccaggguuaaa

SEQ ID NO: 2159 - RNA, 21 nt, Artificial Sequence
  Synthetic construct
ccgggcacuucguaagguuua

SEQ ID NO: 2160 - RNA, 21 nt, Artificial Sequence
  Synthetic construct
uuggagaaauuucacaguaca

SEQ ID NO: 2161 - RNA, 21 nt, Artificial Sequence
  Synthetic construct
caacguggauacacccuggga

SEQ ID NO: 2162 - RNA, 21 nt, Artificial Sequence
  Synthetic construct
cugcgccugcauauuccuaca

SEQ ID NO: 2163 - RNA, 21 nt, Artificial Sequence
  Synthetic construct
uuccacaacguuggaaauaaa

SEQ ID NO: 2164 - RNA, 21 nt, Artificial Sequence
  Synthetic construct
ccagaguccugucgacaauua

SEQ ID NO: 2165 - RNA, 21 nt, Artificial Sequence
  Synthetic construct
cccagagccuguaaaggugaa

SEQ ID NO: 2166 - RNA, 21 nt, Artificial Sequence
  Synthetic construct
ugaaccacugggacuggcugg

SEQ ID NO: 2167 - RNA, 21 nt, Artificial Sequence
  Synthetic construct
uucacaugucuuacucucugu

SEQ ID NO: 2168 - RNA, 21 nt, Artificial Sequence
  Synthetic construct
aagauuuguuccagaaggaac

SEQ ID NO: 2169 - RNA, 21 nt, Artificial Sequence
  Synthetic construct
gagcuccgugaggauaaauaa

SEQ ID NO: 2170 - RNA, 21 nt, Artificial Sequence
  Synthetic construct
uucacagaccuguacugagcu

SEQ ID NO: 2171 - RNA, 21 nt, Artificial Sequence
  Synthetic construct
uacugagcuccgugaggauaa

SEQ ID NO: 2172 - RNA, 21 nt, Artificial Sequence
  Synthetic construct
uccgugaggauaaauaacucu

SEQ ID NO: 2173 - RNA, 21 nt, Artificial Sequence
  Synthetic construct
uacgaacugaacucucucuuu

SEQ ID NO: 2174 - RNA, 21 nt, Artificial Sequence
  Synthetic construct
uucugauggauuaguggagaa

SEQ ID NO: 2175 - RNA, 21 nt, Artificial Sequence
  Synthetic construct
ucugauggauuaguggagaaa

SEQ ID NO: 2176 - RNA, 21 nt, Artificial Sequence
  Synthetic construct
cgaacugaacucucucuuucu

SEQ ID NO: 2177 - RNA, 21 nt, Artificial Sequence
  Synthetic construct
ucaagugaugucaucuuacua

SEQ ID NO: 2178 - RNA, 21 nt, Artificial Sequence
  Synthetic construct
auggcugaacuuucaagugau

SEQ ID NO: 2179 - RNA, 21 nt, Artificial Sequence
  Synthetic construct
gacaagcauauggcugaacuu

SEQ ID NO: 2180 - RNA, 21 nt, Artificial Sequence
  Synthetic construct
gucaucuuacuacugagaagu

SEQ ID NO: 2181 - RNA, 21 nt, Artificial Sequence
  Synthetic construct
uugaauugauaagcugauguu

SEQ ID NO: 2182 - RNA, 21 nt, Artificial Sequence
  Synthetic construct
ucagaugauuugaauugauaa

SEQ ID NO: 2183 - RNA, 21 nt, Artificial Sequence
  Synthetic construct
auagcauguuagaguucugau

SEQ ID NO: 2184 - RNA, 21 nt, Artificial Sequence
  Synthetic construct
aagcugauguucugugaggua

SEQ ID NO: 2185 - RNA, 21 nt, Artificial Sequence
  Synthetic construct
cucacuaugaccgacagugaa

SEQ ID NO: 2186 - RNA, 21 nt, Artificial Sequence
  Synthetic construct
augaaucaaacuagcucacua

SEQ ID NO: 2187 - RNA, 21 nt, Artificial Sequence
  Synthetic construct
aauacaugaacaccugagaaa

SEQ ID NO: 2188 - RNA, 21 nt, Artificial Sequence
  Synthetic construct
augaugaaucaaacuagcuca

SEQ ID NO: 2189 - RNA, 21 nt, Artificial Sequence
  Synthetic construct
uuugugaugacuuacauggaa

SEQ ID NO: 2190 - RNA, 21 nt, Artificial Sequence
  Synthetic construct
cuugcuguugagacucugaaa

SEQ ID NO: 2191 - RNA, 21 nt, Artificial Sequence
  Synthetic construct
ggcugaugacuugcuguugag

SEQ ID NO: 2192 - RNA, 21 nt, Artificial Sequence
  Synthetic construct
auggaaucucguucggcugau

SEQ ID NO: 2193 - RNA, 21 nt, Artificial Sequence
  Synthetic construct
cccagucugaucaauguguga

SEQ ID NO: 2194 - RNA, 21 nt, Artificial Sequence
  Synthetic construct
caccagugaugaguugaauac

SEQ ID NO: 2195 - RNA, 21 nt, Artificial Sequence
  Synthetic construct
cugaucaaugugugacugaaa

SEQ ID NO: 2196 - RNA, 21 nt, Artificial Sequence
  Synthetic construct
ucugaucaaugugugacugaa

SEQ ID NO: 2197 - RNA, 21 nt, Artificial Sequence
  Synthetic construct
uacgaucaggauuacuauaga

SEQ ID NO: 2198 - RNA, 21 nt, Artificial Sequence
  Synthetic construct
cccguggauaugguucaacuu

SEQ ID NO: 2199 - RNA, 21 nt, Artificial Sequence
  Synthetic construct
cagaacugccuuugcacuaaa

SEQ ID NO: 2200 - RNA, 21 nt, Artificial Sequence
  Synthetic construct
cccgaucacgccgcaagcgaa

SEQ ID NO: 2201 - RNA, 21 nt, Artificial Sequence
  Synthetic construct
cagaucaacaaagaugacgua

SEQ ID NO: 2202 - RNA, 21 nt, Artificial Sequence
  Synthetic construct
uacacugauguucuucacuaa

SEQ ID NO: 2203 - RNA, 21 nt, Artificial Sequence
  Synthetic construct
augcugauacagcaccaugaa

SEQ ID NO: 2204 - RNA, 21 nt, Artificial Sequence
  Synthetic construct
aagaccgucaauaagauacua

SEQ ID NO: 2205 - RNA, 21 nt, Artificial Sequence
  Synthetic construct
uccgagguucuucacugggua

SEQ ID NO: 2206 - RNA, 21 nt, Artificial Sequence
  Synthetic construct
cuccgcgucauuguuggaaga

SEQ ID NO: 2207 - RNA, 21 nt, Artificial Sequence
  Synthetic construct
cagccaguccucugagcgaaa

SEQ ID NO: 2208 - RNA, 21 nt, Artificial Sequence
  Synthetic construct
aggaguugcagagaucuauua

SEQ ID NO: 2209 - RNA, 21 nt, Artificial Sequence
  Synthetic construct
cacgauugucaggaaccuuaa

SEQ ID NO: 2210 - RNA, 21 nt, Artificial Sequence
  Synthetic construct
ugggacuuaauuugagcauaa

SEQ ID NO: 2211 - RNA, 21 nt, Artificial Sequence
  Synthetic construct
auggccuuuacuuccaccuaa

SEQ ID NO: 2212 - RNA, 21 nt, Artificial Sequence
  Synthetic construct
cuggcacaugagaucuucgaa

SEQ ID NO: 2213 - RNA, 21 nt, Artificial Sequence
  Synthetic construct
cugccacuuucuagcauccaa

SEQ ID NO: 2214 - RNA, 21 nt, Artificial Sequence
  Synthetic construct
accacuggugguuuaucuaaa

SEQ ID NO: 2215 - RNA, 21 nt, Artificial Sequence
  Synthetic construct
cuggcgcgaaacaucaucaau

SEQ ID NO: 2216 - RNA, 21 nt, Artificial Sequence
  Synthetic construct
cuaguggugucagcagaucaa

SEQ ID NO: 2217 - RNA, 21 nt, Artificial Sequence
  Synthetic construct
cagcccuguuaugucaagcuu

SEQ ID NO: 2218 - RNA, 21 nt, Artificial Sequence
  Synthetic construct
gagcucucuagucuucauuaa

SEQ ID NO: 2219 - RNA, 21 nt, Artificial Sequence
  Synthetic construct
uagcguuugccuacccauuca

SEQ ID NO: 2220 - RNA, 21 nt, Artificial Sequence
  Synthetic construct
ugcgugauuagugauguugga

SEQ ID NO: 2221 - RNA, 21 nt, Artificial Sequence
  Synthetic construct
cagguuauaccgagaacuuaa

SEQ ID NO: 2222 - RNA, 21 nt, Artificial Sequence
  Synthetic construct
cgggacgaugaugacauuaau

SEQ ID NO: 2223 - RNA, 21 nt, Artificial Sequence
  Synthetic construct
cccguccagaucuccaccgua

SEQ ID NO: 2224 - RNA, 21 nt, Artificial Sequence
  Synthetic construct
cgcgguccuguaaagaugaaa

SEQ ID NO: 2225 - RNA, 21 nt, Artificial Sequence
  Synthetic construct
cgcaagcuuugccgagaucua

SEQ ID NO: 2226 - RNA, 21 nt, Artificial Sequence
  Synthetic construct
aacgcuuuacuaaauaccuaa

SEQ ID NO: 2227 - RNA, 21 nt, Artificial Sequence
  Synthetic construct
acgaguugaaucauuguucaa

SEQ ID NO: 2228 - RNA, 21 nt, Artificial Sequence
  Synthetic construct
cccguucuuccuccaaccaua

SEQ ID NO: 2229 - RNA, 21 nt, Artificial Sequence
  Synthetic construct
ucagucaugauuacaaaccua

SEQ ID NO: 2230 - RNA, 21 nt, Artificial Sequence
  Synthetic construct
gagcuuaauaagacccucaua

SEQ ID NO: 2231 - RNA, 21 nt, Artificial Sequence
  Synthetic construct
uaggagauuuacaauaucugu

SEQ ID NO: 2232 - RNA, 21 nt, Artificial Sequence
  Synthetic construct
uggcgaguauguaacacaaga

SEQ ID NO: 2233 - RNA, 21 nt, Artificial Sequence
  Synthetic construct
cccuugagagacaguuucgaa

SEQ ID NO: 2234 - RNA, 21 nt, Artificial Sequence
  Synthetic construct
cacaggaggaauuggauucaa

SEQ ID NO: 2235 - RNA, 21 nt, Artificial Sequence
  Synthetic construct
caggacacuuguggaccgaau

SEQ ID NO: 2236 - RNA, 21 nt, Artificial Sequence
  Synthetic construct
caccagggacauggaguccga

SEQ ID NO: 2237 - RNA, 21 nt, Artificial Sequence
  Synthetic construct
acggcuaugagcacauauuga

SEQ ID NO: 2238 - RNA, 21 nt, Artificial Sequence
  Synthetic construct
uaguuugggaugaauaccuaa

SEQ ID NO: 2239 - RNA, 21 nt, Artificial Sequence
  Synthetic construct
cagcuuagaucucauuccauu

SEQ ID NO: 2240 - RNA, 21 nt, Artificial Sequence
  Synthetic construct
auggagguacagaauauguca

SEQ ID NO: 2241 - RNA, 21 nt, Artificial Sequence
  Synthetic construct
cagguuuauguuacuucuauu

SEQ ID NO: 2242 - RNA, 21 nt, Artificial Sequence
  Synthetic construct
cagcacgcuaauaaugcaauu

SEQ ID NO: 2243 - RNA, 21 nt, Artificial Sequence
  Synthetic construct
augggcucuuaccaaguuuaa

SEQ ID NO: 2244 - RNA, 21 nt, Artificial Sequence
  Synthetic construct
caaggcugugguagaaucaua

SEQ ID NO: 2245 - RNA, 21 nt, Artificial Sequence
  Synthetic construct
caccaaugagguacuacugga

SEQ ID NO: 2246 - RNA, 21 nt, Artificial Sequence
  Synthetic construct
uugagucauaugaauauaguu

SEQ ID NO: 2247 - RNA, 21 nt, Artificial Sequence
  Synthetic construct
gacgucaugaucucuaugaua

SEQ ID NO: 2248 - RNA, 21 nt, Artificial Sequence
  Synthetic construct
cugauaggagccuucagacaa

SEQ ID NO: 2249 - RNA, 21 nt, Artificial Sequence
  Synthetic construct
cagaacguuuguagagauauu

SEQ ID NO: 2250 - RNA, 21 nt, Artificial Sequence
  Synthetic construct
cagagaacgggugcuaauuau

SEQ ID NO: 2251 - RNA, 21 nt, Artificial Sequence
  Synthetic construct
gaggacguuguuauagaagau

SEQ ID NO: 2252 - RNA, 21 nt, Artificial Sequence
  Synthetic construct
uaggucugaaucagugucaua

SEQ ID NO: 2253 - RNA, 21 nt, Artificial Sequence
  Synthetic construct
cagcuuguccuuuagucagua

SEQ ID NO: 2254 - RNA, 21 nt, Artificial Sequence
  Synthetic construct
gcacguguucuggauguauaa

SEQ ID NO: 2255 - RNA, 21 nt, Artificial Sequence
  Synthetic construct
cuaaguuguuguuuaggcuaa

SEQ ID NO: 2256 - RNA, 21 nt, Artificial Sequence
  Synthetic construct
caggaaucaccuucaagccua

SEQ ID NO: 2257 - RNA, 21 nt, Artificial Sequence
  Synthetic construct
uucugcuacggagaaguuguu

SEQ ID NO: 2258 - RNA, 21 nt, Artificial Sequence
  Synthetic construct
aauucaucaucgaaguaccuu

SEQ ID NO: 2259 - RNA, 21 nt, Artificial Sequence
  Synthetic construct
uucauggucacuuuagcccgu

What is claimed is:

1. A method of screening a compound for effectiveness in reducing viral infection, comprising administering the compound to a cell containing a cellular gene functionally encoding FKBP8 and detecting the level of and/or activity of the FKBP8 gene product produced, a decrease or elimination of the gene product and/or activity of the gene product indicating a compound effective for reducing viral infection.

* * * * *